United States Patent 12,180,497 (RESISTANCE GENES ASSOCIATED WITH DISEASE RESISTANCE IN SOYBEANS) - sequence listing, part 10

SEQ ID NO: 6 - DNA, 1966948 bp, Glycine tomentella
  misc_feature (7504)..(8150): n is a, c, g, or t
  misc_feature (10734)..(11814): n is a, c, g, or t
  misc_feature (20358)..(20598): n is a, c, g, or t
  misc_feature (26385)..(26579): n is a, c, g, or t
  misc_feature (32722)..(33739): n is a, c, g, or t
  misc_feature (39864)..(40299): n is a, c, g, or t
  misc_feature (47711)..(48352): n is a, c, g, or t
  misc_feature (68586)..(68831): n is a, c, g, or t
  misc_feature (72251)..(72691): n is a, c, g, or t
  misc_feature (80375)..(80384): n is a, c, g, or t
  misc_feature (81081)..(81862): n is a, c, g, or t
  misc_feature (90066)..(91178): n is a, c, g, or t
  misc_feature (96404)..(97282): n is a, c, g, or t
  misc_feature (101204)..(101822): n is a, c, g, or t
  misc_feature (108393)..(109057): n is a, c, g, or t
  misc_feature (124587)..(124971): n is a, c, g, or t
  misc_feature (149640)..(149818): n is a, c, g, or t
  misc_feature (154670)..(155896): n is a, c, g, or t
  misc_feature (156372)..(157519): n is a, c, g, or t
  misc_feature (166810)..(168477): n is a, c, g, or t
  misc_feature (169286)..(170940): n is a, c, g, or t
  misc_feature (174496)..(175781): n is a, c, g, or t
  misc_feature (177170)..(177584): n is a, c, g, or t
  misc_feature (182202)..(184208): n is a, c, g, or t
  misc_feature (188991)..(189065): n is a, c, g, or t
  misc_feature (189827)..(190236): n is a, c, g, or t
  misc_feature (212674)..(212993): n is a, c, g, or t
  misc_feature (227240)..(227249): n is a, c, g, or t
  misc_feature (232892)..(233559): n is a, c, g, or t
  misc_feature (240512)..(240886): n is a, c, g, or t
  misc_feature (244342)..(245152): n is a, c, g, or t
  misc_feature (249043)..(249519): n is a, c, g, or t
  misc_feature (253165)..(253174): n is a, c, g, or t
  misc_feature (254620)..(255109): n is a, c, g, or t
  misc_feature (270096)..(271085): n is a, c, g, or t
  misc_feature (277057)..(277614): n is a, c, g, or t
  misc_feature (283272)..(283526): n is a, c, g, or t
  misc_feature (285102)..(285257): n is a, c, g, or t
  misc_feature (286105)..(286353): n is a, c, g, or t
  misc_feature (293337)..(293346): n is a, c, g, or t
  misc_feature (298634)..(299634): n is a, c, g, or t
  misc_feature (304935)..(304944): n is a, c, g, or t
  misc_feature (310909)..(311682): n is a, c, g, or t
  misc_feature (313997)..(314628): n is a, c, g, or t
  misc_feature (318721)..(319507): n is a, c, g, or t
  misc_feature (326696)..(327433): n is a, c, g, or t
  misc_feature (330571)..(332039): n is a, c, g, or t
  misc_feature (332842)..(333085): n is a, c, g, or t
  misc_feature (351192)..(352188): n is a, c, g, or t
  misc_feature (356966)..(358976): n is a, c, g, or t
  misc_feature (360083)..(360092): n is a, c, g, or t
  misc_feature (368422)..(368830): n is a, c, g, or t
  misc_feature (369693)..(369755): n is a, c, g, or t
  misc_feature (374012)..(374726): n is a, c, g, or t
  misc_feature (376769)..(376938): n is a, c, g, or t
  misc_feature (400807)..(401205): n is a, c, g, or t
  misc_feature (404267)..(404509): n is a, c, g, or t
  misc_feature (407308)..(407535): n is a, c, g, or t
  misc_feature (409840)..(410139): n is a, c, g, or t
  misc_feature (413432)..(414181): n is a, c, g, or t
  misc_feature (415583)..(415592): n is a, c, g, or t
  misc_feature (420779)..(421530): n is a, c, g, or t
  misc_feature (422178)..(424409): n is a, c, g, or t
  misc_feature (427794)..(428277): n is a, c, g, or t
  misc_feature (440364)..(440469): n is a, c, g, or t
  misc_feature (446931)..(447159): n is a, c, g, or t
  misc_feature (458166)..(458313): n is a, c, g, or t
  misc_feature (465841)..(466440): n is a, c, g, or t
  misc_feature (467704)..(468794): n is a, c, g, or t
  misc_feature (491679)..(492025): n is a, c, g, or t
  misc_feature (494379)..(494796): n is a, c, g, or t
  misc_feature (497047)..(497360): n is a, c, g, or t
  misc_feature (499672)..(499920): n is a, c, g, or t
  misc_feature (519381)..(519426): n is a, c, g, or t
  misc_feature (523545)..(523946): n is a, c, g, or t
  misc_feature (538320)..(538567): n is a, c, g, or t
  misc_feature (542165)..(542752): n is a, c, g, or t
  misc_feature (544415)..(544453): n is a, c, g, or t
  misc_feature (567758)..(568886): n is a, c, g, or t
  misc_feature (574129)..(575180): n is a, c, g, or t
  misc_feature (579541)..(580373): n is a, c, g, or t
  misc_feature (586447)..(586771): n is a, c, g, or t
  misc_feature (590267)..(590551): n is a, c, g, or t
  misc_feature (603951)..(604208): n is a, c, g, or t
  misc_feature (605417)..(606302): n is a, c, g, or t
  misc_feature (608586)..(610014): n is a, c, g, or t
  misc_feature (612016)..(613153): n is a, c, g, or t
  misc_feature (615079)..(615810): n is a, c, g, or t
  misc_feature (617968)..(619202): n is a, c, g, or t
  misc_feature (622877)..(622886): n is a, c, g, or t
  misc_feature (637855)..(638370): n is a, c, g, or t
  misc_feature (658468)..(659188): n is a, c, g, or t
  misc_feature (660779)..(660788): n is a, c, g, or t
  misc_feature (663956)..(664457): n is a, c, g, or t
  misc_feature (668242)..(668251): n is a, c, g, or t
  misc_feature (672470)..(672788): n is a, c, g, or t
  misc_feature (673667)..(673676): n is a, c, g, or t
  misc_feature (674747)..(674985): n is a, c, g, or t
  misc_feature (681184)..(682536): n is a, c, g, or t
  misc_feature (682907)..(683895): n is a, c, g, or t
  misc_feature (694441)..(694788): n is a, c, g, or t
  misc_feature (702649)..(703533): n is a, c, g, or t
  misc_feature (705263)..(705272): n is a, c, g, or t
  misc_feature (706346)..(706482): n is a, c, g, or t
  misc_feature (712298)..(712536): n is a, c, g, or t
  misc_feature (720417)..(720937): n is a, c, g, or t
  misc_feature (739952)..(740634): n is a, c, g, or t
  misc_feature (763932)..(763961): n is a, c, g, or t
  misc_feature (769833)..(770659): n is a, c, g, or t
  misc_feature (773201)..(773657): n is a, c, g, or t
  misc_feature (775640)..(776968): n is a, c, g, or t
  misc_feature (785274)..(786272): n is a, c, g, or t
  misc_feature (788123)..(788398): n is a, c, g, or t
  misc_feature (792091)..(792145): n is a, c, g, or t
  misc_feature (802901)..(804169): n is a, c, g, or t
  misc_feature (809893)..(810581): n is a, c, g, or t
  misc_feature (829697)..(830088): n is a, c, g, or t
  misc_feature (839102)..(839544): n is a, c, g, or t
  misc_feature (856416)..(858025): n is a, c, g, or t
  misc_feature (860115)..(860189): n is a, c, g, or t
  misc_feature (865921)..(866397): n is a, c, g, or t
  misc_feature (869770)..(870306): n is a, c, g, or t
  misc_feature (876639)..(877649): n is a, c, g, or t
  misc_feature (878278)..(878287): n is a, c, g, or t
  misc_feature (879898)..(880497): n is a, c, g, or t
  misc_feature (882861)..(883526): n is a, c, g, or t
  misc_feature (897127)..(897493): n is a, c, g, or t
  misc_feature (907119)..(909188): n is a, c, g, or t
  misc_feature (911343)..(912717): n is a, c, g, or t
  misc_feature (912952)..(913061): n is a, c, g, or t
  misc_feature (914493)..(915066): n is a, c, g, or t
  misc_feature (923188)..(923881): n is a, c, g, or t
  misc_feature (925481)..(926037): n is a, c, g, or t
  misc_feature (930440)..(930801): n is a, c, g, or t
  misc_feature (931658)..(933889): n is a, c, g, or t
  misc_feature (936511)..(937358): n is a, c, g, or t
  misc_feature (939510)..(939654): n is a, c, g, or t
  misc_feature (939827)..(939906): n is a, c, g, or t
  misc_feature (946242)..(947327): n is a, c, g, or t
  misc_feature (961532)..(962740): n is a, c, g, or t
  misc_feature (964531)..(964779): n is a, c, g, or t
  misc_feature (975452)..(976077): n is a, c, g, or t
  misc_feature (983244)..(983707): n is a, c, g, or t
  misc_feature (989157)..(989799): n is a, c, g, or t
  misc_feature (990938)..(991624): n is a, c, g, or t
  misc_feature (997265)..(999041): n is a, c, g, or t
  misc_feature (1020842)..(1021574): n is a, c, g, or t
  misc_feature (1022415)..(1022557): n is a, c, g, or t
  misc_feature (1024274)..(1025443): n is a, c, g, or t
  misc_feature (1031529)..(1033776): n is a, c, g, or t
  misc_feature (1033954)..(1034032): n is a, c, g, or t
  misc_feature (1034816)..(1034988): n is a, c, g, or t
  misc_feature (1040900)..(1041153): n is a, c, g, or t
  misc_feature (1074341)..(1074431): n is a, c, g, or t
  misc_feature (1080116)..(1080125): n is a, c, g, or t
  misc_feature (1080362)..(1080371): n is a, c, g, or t
  misc_feature (1095295)..(1095620): n is a, c, g, or t
  misc_feature (1101180)..(1101594): n is a, c, g, or t
  misc_feature (1102339)..(1102348): n is a, c, g, or t
  misc_feature (1110942)..(1110969): n is a, c, g, or t
  misc_feature (1117480)..(1117990): n is a, c, g, or t
  misc_feature (1120804)..(1123126): n is a, c, g, or t
  misc_feature (1143972)..(1144313): n is a, c, g, or t
  misc_feature (1151192)..(1152475): n is a, c, g, or t
  misc_feature (1153102)..(1153111): n is a, c, g, or t
  misc_feature (1153617)..(1153865): n is a, c, g, or t
  misc_feature (1155709)..(1155758): n is a, c, g, or t
  misc_feature (1158522)..(1158531): n is a, c, g, or t
  misc_feature (1170856)..(1172293): n is a, c, g, or t
  misc_feature (1172884)..(1173370): n is a, c, g, or t
  misc_feature (1184055)..(1185127): n is a, c, g, or t
  misc_feature (1190752)..(1191855): n is a, c, g, or t
  misc_feature (1200527)..(1200536): n is a, c, g, or t
  misc_feature (1200889)..(1200898): n is a, c, g, or t
  misc_feature (1221024)..(1221432): n is a, c, g, or t
  misc_feature (1222861)..(1222870): n is a, c, g, or t
  misc_feature (1224656)..(1225681): n is a, c, g, or t
  misc_feature (1245418)..(1245783): n is a, c, g, or t
  misc_feature (1249796)..(1250194): n is a, c, g, or t
  misc_feature (1252636)..(1254178): n is a, c, g, or t
  misc_feature (1255378)..(1255846): n is a, c, g, or t
  misc_feature (1257955)..(1258538): n is a, c, g, or t
  misc_feature (1262087)..(1264127): n is a, c, g, or t
  misc_feature (1266690)..(1268328): n is a, c, g, or t
  misc_feature (1268877)..(1269003): n is a, c, g, or t
  misc_feature (1282450)..(1283203): n is a, c, g, or t
  misc_feature (1288372)..(1288728): n is a, c, g, or t
  misc_feature (1297510)..(1297767): n is a, c, g, or t
  misc_feature (1299724)..(1301110): n is a, c, g, or t
  misc_feature (1305101)..(1305150): n is a, c, g, or t
  misc_feature (1309095)..(1309611): n is a, c, g, or t
  misc_feature (1318211)..(1318947): n is a, c, g, or t
  misc_feature (1322619)..(1322744): n is a, c, g, or t
  misc_feature (1348102)..(1348474): n is a, c, g, or t
  misc_feature (1352501)..(1352943): n is a, c, g, or t
  misc_feature (1354621)..(1354774): n is a, c, g, or t
  misc_feature (1362656)..(1363450): n is a, c, g, or t
  misc_feature (1367790)..(1368985): n is a, c, g, or t
  misc_feature (1370912)..(1371029): n is a, c, g, or t
  misc_feature (1374882)..(1375767): n is a, c, g, or t
  misc_feature (1375960)..(1376100): n is a, c, g, or t
  misc_feature (1393648)..(1395156): n is a, c, g, or t
  misc_feature (1397732)..(1398531): n is a, c, g, or t
  misc_feature (1407648)..(1407657): n is a, c, g, or t
  misc_feature (1415010)..(1415019): n is a, c, g, or t
  misc_feature (1415930)..(1416491): n is a, c, g, or t
  misc_feature (1420611)..(1421073): n is a, c, g, or t
  misc_feature (1426324)..(1426619): n is a, c, g, or t
  misc_feature (1428357)..(1428668): n is a, c, g, or t
  misc_feature (1444669)..(1444973): n is a, c, g, or t
  misc_feature (1460964)..(1461594): n is a, c, g, or t
  misc_feature (1464267)..(1464714): n is a, c, g, or t
  misc_feature (1469137)..(1469423): n is a, c, g, or t
  misc_feature (1473195)..(1473391): n is a, c, g, or t
  misc_feature (1477673)..(1477706): n is a, c, g, or t
  misc_feature (1483515)..(1484088): n is a, c, g, or t
  misc_feature (1555148)..(1555956): n is a, c, g, or t
  misc_feature (1574703)..(1575413): n is a, c, g, or t
  misc_feature (1589190)..(1591200): n is a, c, g, or t
  misc_feature (1594682)..(1596954): n is a, c, g, or t
  misc_feature (1603796)..(1604242): n is a, c, g, or t
  misc_feature (1605596)..(1605786): n is a, c, g, or t
  misc_feature (1606253)..(1606282): n is a, c, g, or t
  misc_feature (1608438)..(1608557): n is a, c, g, or t
  misc_feature (1609603)..(1613745): n is a, c, g, or t
  misc_feature (1616409)..(1618272): n is a, c, g, or t
  misc_feature (1620025)..(1620597): n is a, c, g, or t
  misc_feature (1621416)..(1622682): n is a, c, g, or t
  misc_feature (1632346)..(1632978): n is a, c, g, or t
  misc_feature (1633936)..(1636026): n is a, c, g, or t
  misc_feature (1637788)..(1640216): n is a, c, g, or t
  misc_feature (1640653)..(1643204): n is a, c, g, or t
  misc_feature (1657650)..(1657910): n is a, c, g, or t
  misc_feature (1663857)..(1664019): n is a, c, g, or t
  misc_feature (1664989)..(1665555): n is a, c, g, or t
  misc_feature (1669028)..(1669244): n is a, c, g, or t
  misc_feature (1685271)..(1686112): n is a, c, g, or t
  misc_feature (1688353)..(1688818): n is a, c, g, or t
  misc_feature (1693037)..(1693488): n is a, c, g, or t
  misc_feature (1693933)..(1694565): n is a, c, g, or t
  misc_feature (1695194)..(1695827): n is a, c, g, or t
  misc_feature (1707962)..(1707971): n is a, c, g, or t
  misc_feature (1709898)..(1709907): n is a, c, g, or t
  misc_feature (1716225)..(1716390): n is a, c, g, or t
  misc_feature (1716754)..(1718987): n is a, c, g, or t
  misc_feature (1720718)..(1721262): n is a, c, g, or t
  misc_feature (1730594)..(1731998): n is a, c, g, or t
  misc_feature (1732590)..(1734112): n is a, c, g, or t
  misc_feature (1740261)..(1740270): n is a, c, g, or t
  misc_feature (1743079)..(1743239): n is a, c, g, or t
  misc_feature (1744581)..(1744630): n is a, c, g, or t
  misc_feature (1768653)..(1770248): n is a, c, g, or t
  misc_feature (1770710)..(1772190): n is a, c, g, or t
  misc_feature (1788124)..(1789201): n is a, c, g, or t
  misc_feature (1791581)..(1792888): n is a, c, g, or t
  misc_feature (1812878)..(1813866): n is a, c, g, or t
  misc_feature (1819052)..(1819061): n is a, c, g, or t
  misc_feature (1823073)..(1824431): n is a, c, g, or t
  misc_feature (1825005)..(1825245): n is a, c, g, or t
  misc_feature (1827954)..(1828476): n is a, c, g, or t
  misc_feature (1831380)..(1831579): n is a, c, g, or t
  misc_feature (1835023)..(1837091): n is a, c, g, or t
  misc_feature (1840609)..(1840948): n is a, c, g, or t
  misc_feature (1844813)..(1845036): n is a, c, g, or t
  misc_feature (1854295)..(1854416): n is a, c, g, or t
  misc_feature (1856501)..(1856588): n is a, c, g, or t
  misc_feature (1863506)..(1863926): n is a, c, g, or t
  misc_feature (1866705)..(1867810): n is a, c, g, or t
  misc_feature (1874510)..(1874863): n is a, c, g, or t
  misc_feature (1875643)..(1876059): n is a, c, g, or t
  misc_feature (1878768)..(1878777): n is a, c, g, or t
  misc_feature (1881011)..(1881388): n is a, c, g, or t
  misc_feature (1887638)..(1889502): n is a, c, g, or t
  misc_feature (1890225)..(1891769): n is a, c, g, or t
  misc_feature (1899292)..(1900230): n is a, c, g, or t
  misc_feature (1908104)..(1908478): n is a, c, g, or t
  misc_feature (1911624)..(1913098): n is a, c, g, or t
  misc_feature (1919518)..(1920058): n is a, c, g, or t
  misc_feature (1933905)..(1934811): n is a, c, g, or t
  misc_feature (1937882)..(1939872): n is a, c, g, or t
  misc_feature (1940618)..(1940876): n is a, c, g, or t
  misc_feature (1946072)..(1946765): n is a, c, g, or t
  misc_feature (1962922)..(1963258): n is a, c, g, or t
  misc_feature (1964099)..(1965853): n is a, c, g, or t
cttgaactcattaaagcaattgaccctgactaaagaaaataagaaagcgaaccatttttttttatcagcaaagataatattatatatatatatatatatatatatatatatatatatattaaagatgagtacaagtagtactcagaaagaaatacaccccagggaacctaccagaattttggcaacctaatacatggtaacagcctgaattaaggtgccaaagatcaacctaatagtaagctcacctgaaggcggtcacaaaataatacctcccctacttatagaacccatctctaatatggttagaccaataatagaagggaatattaaatcttttttccaaattaactaacatagaccaataaaagaataaaacattcttcaacagtttagatccattaaaaattttattatggaaaacaatcttgttacaatgaaaccaaatgttccatgtcaatgctatccaccaagcatatcacctttgaattttaaggccagtaacataacagtaacagtgttgaaggaagtgctcaataggagtaattggtaatgcccctaccacactgatccagcccaaagattcccatcacagcaacataatgttgtgacaactaaaaaacacatgtaatgcatccttaacacagctaccacaaaaaagacaactatgatcacccaaatttatgtgtctatggggcaattgatctctcagtaacctccaagcaaaacaagtggctttgtttggaatggcagtttcccaaggtttgtgtacacctccttctgagtctaaatctccacccctctgcttaaagtcttgtaagcactttccaccgtgtatctaccattcagggcaccctcccaccaactatcctactggtcaggatgtatggtcagatcctgaatttcctctaagaatttaattgcaatttcaacttcctcctccctaaagcaccttctccaattaagttttcattcccacccatcatgtgacagagatcccatttgctaaataaattgctgttgttgttgggagatgtggtacactctaggaaatttcgtcctcagaggtataccatcttccttccaaccatctttccaaaataatacctttgatccgcagccaaccctccatttagtttccttattaaaccacccctcctcaacactaggttggcatacactacaaaggtcccgccaccaaatagagtcactagtaggtcttctcgaagcatcaagatttcgccaactgtcatattttgactccaagacttgtgaccacaattccccttgacagtgaaacaagttccaccgcggttagttagctttaatttattttacatgcttcactagctggccataacaaactttgcaacgtaatgaatgtttaaactgttaattattgataattgataattttacaatgaactaacgagatactttccaacagactgcaagcctataaacaagaatcagaattctggcaatctacatacacaagtggtgaactgatttgacatccaagaagcagagcatttgaaacccttgggtaatccaaaacaaattgatgctatacaaaaaatctatttcaaccaatcagcagctgcccttccagcaaaataactaagaatttcaccaaaaagaaaacagatagcttaatggcaaactagtttaatcctacaaagtccaactggaagctggaatcccttgtttctggaaccaatcaggcatgtggaacttttcatagagcaaaggtcttacatcattctgctcagaaagttgcttgagaagtggaagaatgacatctagaagctgttacacatcaaaatagaggagatgatggtgagcaattcataaaagtatcagatgagtgatttattttattttaagcattggtggtcttaaatttcaatagcacagatctttgcacacctgggtgtcatgtggttgcccagcagaaaatggaatgcacggaattccattcaccggttgtaatacaaagctgaaaggattattgtctacaataacaatgcgacaaagatcctttgagatgcaggtaagatccttgacatgttcccgatattccctgcaatcaaacagcatttataagaatgcttgtacaaatccatccagcagaatccattctgaacttcaaactcaaacacatacaccccaaaataactttaaaaattccagaaatgatgcagatcatttaataacatttaaaaaactacaaagaaactcctcgcagactgaaaatactgtgaaaagaaacaataaaattttaagtttgtaatatcaatggtacatacaaaccagcctggtgtgaacaacagtcggttgttatgatttgttagcatgatttcagcagttgagtttatattgagcccaaaaagaaaaagtacatccaaattcaactgtgaccttgattatgcagaacatagttcagaactgagagaaatgcaaaagcgtagaaatttaatcccatgcattactcaagtggttatgatgggtggggatttgggtagagctctagagtttgggtgtggtaacaactccaattatatcaaaaatgaaatcatagacaaaacatccaaaagtcagtttggataaacttctcaacaaatatttacaggaaaagaaaatataatgaaccaaacttctcacataaactaaaatcattatatgcacttcaatttatgaagtttgatgaaagagttattgaaaaatttgaggtgcataagttgatttttaacatgagaagttagatcattctacctcgattcattttattttcttctctagaagtgcttaatgagaatatttgccaaactggctctctacagttttgtccctctcaaaaagattctggtaaaaccaacaaaagaatcaagacatttagccagaaaatccaaagcatgtaatccctcaggactttgaagatattacaaaagccatccaaatgttttttttctggggaaagcataacaacaaaaatgaccacaagatgtaccattcttcgagacttgtttacactctactaatttaagtaagatcacacacacacacacacacacacacacacacacatatctagtataaatgataaaataatatcataaacataaatatatagctggaaaagaaaaaaaaagaagacatttagaaacaattaaagagaataattgctgcacagttcttctataacagcacaaaactttcatccatttagctatgcagcacactgcagtcaaatttagcagatgctcataagctcattcggtccaaaagtgtccagcattattatatgaatgcaacaaatttgcaccaaatatcaatttttgttggtggtttatcagttttgtaaagattcaatgaccgaccctccaacttatagagaagataggcatagaccatgaaaacatgggctggtaccagaaaaacaaggaataaagaaccacaactaaaaataaaatgaactataatattaattcacatatagttggctggctatcagccatgaaaacagaaagattaattacataaaaacagaacactggattggaaacaaggtagatacacttacgtgctaattgttgagggccgataaagtcgtagactgaatcgattttccacatctattctgtcaacaaggggtctagcatagcctgtaagaatttataggcatatgtcattcagaaatgttgaacataattcccaaatgatgaatatgcacaagtacagcagcttagtattttgggacaaaccttcaagaccagctgtaaacagcaccatgtcagcaaattcactgagttgctttaaaaattccttcaacccagggcgttcaaatactgtaacataattgatttttttgccttctccttccttgaaaatccaacatggtcaagtgaggatataatattctagttgtcgacaagcaatcagatgcaaattacaaagtaacttaccttgtctatcgatacacattccagctcaaaccaattcaaaccaccttcgattgcttgagtccgtaaagcagctggcaaacttgatgtctcgtatgcacataccagtgtttcatctaagtccagcacaacctacaagtgcacatataagatcaaaatctacattagcaaaaggaaaagagaaagtaataaaagaaaattaatgacatcattaacattcttctaacagctcatcaatagaatacaccttataccacttctcattcttcttttctgactaacaaaaaaaaattcaaaccggtatgttttgcatgccaaatttgggcatttgcaagtgtgtgccaagggtaaatgtaaagacatggaaattaaaacaaaataacaactcaacgagagaatctacacgcaaatagcatggttgaaacatgtgtacatgaataaaactgagtcagattaagataaaaacgcagaaactacagtgtgtagcttctgcttggacacacgtaaatcttggaatccaaacatgtggtaaatatcaatgaggaagttttcgaaacacatcaccatatattacaatttacaagcaaactaaggaatcggtacagcagacagcaatataagaacaaatcataaatccctccatcataaaaatccaaaacacaaggggcttcaagctgaactgcatatgttgcaacaagagtgactcaactctctgaggcaagcaacagaaatcagtacacacaaccaaacccagaggacaagcttccacagtctcattccaaatgtccccaaacaagagaaagacatttctaatgttttgtcttctgtcttagatgcttccaaaaaccctttgagttcatggaagccaaccattttccactttgagcaagtcaacaagaccatcccaataaactttataaatatgcatgttcaagtaaaaccaaaaccaaaacgaaaccagaacatccagctaatgttcaagtttaaacaaaatccaaatacaaaaacaagaaaccaggaaactaaaaaaaaaaaaagggtacaaaacaataagacaacaacgaagttagaagtataacaaaagacaaaagcaaatcatcctcatccccgaaacacagattcacccgtataacacgcacagtgatctttatcaactacaaacaagtattcctattcacctccttagacatgcaaatttcagcatccttctcaaaccctactcagatcagagccaaagtcaaaagtttttattttttttacaaaaagacactaaaatcctgaaatgaaaaactgaagcactagttatattatcttcaacacatcaggaattaaccaattaatcctcgaacagaacaccttttttttctcttctcactgaacacaaaaacagagaaaataattaaaaaagaaaagaagtggttggttgctacggtaccgtgagttttgggacgggatgatcggcgggggaataatcaagtggtgagatttcgagggcggagagaggaggcgaatcgtgttcagcaagctcaacggagggaagaggtttgaaggaagaggaagaggaagaaacgtttgaagaagaggaagaagaattagaagagaaagagagtagaggatagtgacctaaggctcttataatctggaagaagatctgaaagaagaaggccaaccaactcaacagtgccctccacgcttgctgagtccgaggcgagtacacctccgcctgagtcaactcgcccatattccccaacacaaaaacctaaccaacgatcgatcgatcgatgcaaattgattattaatctcttgcgttgcgattgtgccgtgctgcttacggggtgtttcgattctctctctctcttttgcgtgtgagcgattttcagagagatgttgtggtcatggtggtgcttcgacgaggtctagagagagagagagagagagagagagagggaaaggaaaggaaaagggctacggagattgacgcacgcgctgcggttgcgcgtgaggtctttggtggcgcgttagtcagaaattgccttctagctttttgtgtattttggatgtttttgctttttctgcggtcatcattcattgactgcgcttaatagggtcgaaaatggaaatcaccttcttagtagtattgaattttatttgtgttatcaataagaattttagtccttaattcgagaacttaaacttaaaattagggattctctaaaaaaaattaaacatgaattctggaattaaattgattattcgctaaaaaataaaattaattgatttcataaactttaatgaaaccctacaaacttttaagttttaaggatttattttaatttattttaaactttagtggacaaaattagatgaaagctgaaaattaaaaaaatagttaaatgtttaaaattaaaaattaacttattaaataatattatttttaattttttatataaataatatagtgtaaatcatcaaaattaaagaaagtggtactcacatttaatattatcataatttaaattttatttcaaaaatattattaagtttaaatgtagtaagtgatagtatcatttaatattaaaactttaactttgaataagtttgaaaattagtcattgttgtttacggataaaagaaaaacaaatataaaataatcaaaaaaagtaaagtaacaaaaatatgatttatttaaaaaaaattaagaaatttgataaaatatattaaagataaaaaagaaaataaatattaaaaactataaattaaaaacaaatattttaaaaatactatttaattaacattaaaaattactaaaataatttatttattaaataactaaataattttgttgactaataactttttaaaaacaaattaaaatatcttcttcaacataatcttattttcaatactaatattacatcaagatacaaattagggagtaataaaaagcaacatatgcgggtaatgtatttaattaattaactagtgttttataaataatgcagggcagggatggttgataattgaggcaatgtccgaaaacgcgcagtgagggagcgtgaggggagaggatgttcatgattgtgatgaacaaatgataaataaagaatgagacaataagaaaagacaatctttgagtctttaaagacttcgtccttgttcttcaaattattaaattagaatttcagaataaattaaattagttggactcacagacacaacacgagtcaggatctgaaaacttaaaagattgttgtagcaattggttatgagagtgataaaattagaaactaaattatttttttgaacgttttttaatcacatttaactgtgtgcgaaaagctttagaagtatgtcatcacattcaaaataaataatgttgtaacaaattaaattagtcttattttgttttttaaaggtttaagaaatttgatataaatttactctttattcataaacaaatagatacgaaacaaccttgctgtttggtatttttatatgtgggaattaaaaatgatattaaaaggttataataatttgctcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagttgaatgagaagaagtctcctcgtattttaaacatctataaattacaaatatttcatcaatagttttaattattttttatcattctttttctatcacattagtattaataaactcaatcacttatttcttctctctttctatctctctcaaggtataaacacttaagggataactatgaaaataattcgagttatatttggtgaaaagaggatcattattcattcttttgaatacactctttattattaccaaaaattattgaaaattacaacctttaatgaattttacttttcatttaatgaatcttttattttttaataaattttaactaatagtaagtaagtgtgttttttaaaaaaaatattttgaaagtatattgctgacacttctcattaattttgataacaaataaaaatgacttttgtatttcttatgttgaaatttaaaatttaaaatatacttattaaataaaaattaatttcaaaagagtatagtgtttaacttttttttttttaccgtattctcttgattaagttttagggttcgtttggtagagcaaaataaagtgaaaaatgaatgaaatgaacattgtacaatccacacttttacttgttactttaattcaaaacttttatctattttcatttcactctactaaatatacacttagacatgcaattattttaaatattcaaaaagatgattttattatttataataatcttatccaacttaaacataataataaaaaatacatgtgatctaaaaaaattgtttttttcttccgataaaaattaatgtagttagcaacacatcattaggggtgtaaaacaaaacaagtcagaccgaatcggattgtaactgactcgacgtgactctgtgtcttaactggattgtaacaaaaaaactatctcattttaaaaccaatttggatttgactcgtcctgattctccaaaagcaacaagtgacccgaaattgtgctgtgattttctctcttgtctctcctctcggcatagtctcgctctctctcgtgactcaatctcattgcttactctcactctcaatctcacaatcagtgaaccctaattgtggattcacttcattttgcgttttgatttgtttggcttcatttgaggattcaccgtaatgttcgaagaccctttttcgtttgtttcttgtgattttgcatttttctattgtttgactacccttttgagttttgatttgcatcgattgcatttggcttcatttgcatcgaagaatgtgattttaagaacttttgtggtggttttgacttgctttattattgttgggttgttgttaatattttaaaccaaataaatggtagttttggttcatcaattccctgatgttatgctgcaattgaattcttaaacaactttaattgtctgcatctaagttacattacatgatgatgatgtcttccaaaccaaatccaactcaattgtttttctgtctcaagtgaagtttaaaaagggaaacctagtatatcatgtggataaaatatatttcagttctactctcggacaagaattgtcgtgatgttttacaaaatacatgttcgatttgattggttcaggtacataaacttttccatttggccctattgacagtgctgaataattttgatattctatttacttatcttttattgagcctagaataagctttattctttgttttccttcaggttcgagttatgaaggatttgtatgacatgctttcaaaggtcaggttctattttttagattattttgtttaccttgtctatatttatggttggaatttcgtaacacaattttgaatttctttgagaattggtttgactttaagaaattgataggattagagacactaaatttaggtggatcaataacgtctttgtataacttctatttgctcatagtcatatatgtctaaatgaagagtgttggtcttttagtaagtggcatgataaattggtataataactttcacttagatgcttaatttattgaagctacataagagaagtacatcttctatataattttgtatttattttttgttataatcttttttattaagtgtttaaaatcaaatttcatgatggaaggaaaaaactttcatttttccaatccaaataaagtaaatttttttatataaaaaaatggttcaacatgttgtattagatatgagtagaagaatccaacttgatattctttaaaaaaaaagtttttaaaatcggttccattcttaaaatcaatttaaaatcggttcaaaaccaattctgtttcaaatcggttatcaaatgagttcgcgtattcagattaaaattgaatcagtttaactagttaaaatccaaataatccaatgtgaatatcaaattagcaataaataaaaaatgatttttttgttgataaataaatattcaatttttgaaacatcatttgttatatacaagactagaaaaatttagtaaaagtaaagcgaacatgattttttttataatttttatatgatatttttttatgaaatatttttagttccatatttttaagcataattgataataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacataatagatgttcataaaatattttcattgaaaaattctccaaaatgtcacacatccgtattattccttctagacttatatataaacaaaaataattaatttcacaataattaatttaattttattaatatcaaataaaaaataaatttatttctaaaatatccgttattggaatgtattatcatgaataaaaaacttcattgaaaatagaattataattaaatgaaaaatatttttaaaaaaataattaaaattatatatatttaaattaaagatattttttatttatttatatgcaattctaagaataactcataaatgaagtatgtgttttctgttccatcagcggtcaacgttgttggtaattggatcagacttgaatgcagtggacagtggtgccatcaagatcttatttatagtatggtcgttggaaatcattaaaatggtagatatgtcactatttatgactcaaaactgaaaacatcagcttcctttctcaattagtactaatacattctttcttttctcgtttagcctcgaattttcacgttgtatttctttaaattttaaattaatattttttattttaatttatagtactttttttgttatcttacttaatatttgtgtataaatgaaaaaaatcacaatttagtaataattttttattaattagttattttcaagttttataaattaaataattaaaacatatgttttatatttaattttttatcgctaataaaaaaaatctttctacttttgatataatattcttatatatatatatatatatattataaaaaaatatttcatttgttagaaaaatatttaactcatcaactcacgacagatcatttcattgagttaggttattaatttttatagtattatataacttatttaataagcaagtcaagttaaagtgaatcattttttaaaaaccatgcattttttaaaaaatatgcgacgaattaattcatcatctcttgtttgtttaaatgaaagagaattaaaaatgagtgaaatgaataacaaaatgagataggatttatatttttacactcaattttaaggtcaattttagggtggaccacttgataagtgattcaaaagaatcataattcttaatcattagatcaatcttattactataggtatgttcacactaaatcccctgaacctttgtcgcaactcccttgaccacattcactgatgtcagtcgacgacgacgtttttctccttccttacctccacactgtctctcttttctctgacaatctcttcagctttgtttttcctttcccttgccaggacttctaccataaggggtcgatgtgtggatagatccacactgacaccaatgccccaaaaaatcttacatttctattttcttttacaggttaaagtgttttcaccacaaaagaggagcatggagagaaatttggagctacaaatgtcactgtgagattcatacatgaacagttgaaaccgtcagagccttacccagatatgtttctcattgtgatagttattgcttttgttcttaacccaagacctagattcatacctagatcaacttgtgagtgatagggagactaacataaaagagaagcatagacaaatagacgatagtgaaaggggaacatgcagtgacgacgaaattgttgtctcgttgctcttgatggacttggcatctatgttgagattgtacccgggaggcccacccgagccaatctactttttcaaccgcaaagaaatggaacaagaaattagggaagggaagggaatgaacaagtgctcctttgggttgataaatgcaactttattagccagtgtggatgtgaatgggcttgcggatgcgatggtgacgtacaaggggctgttggagaatgggatggggaggtgatagttgttgtcgtcactggaggagtcttcatggagaatagagaggaggtgggaggggtccaaggtgggggtcatggattttgaaacaccttcggcgatagatatcagtgatcgaaaaaacttgttaggaggagattgaaagatccagtgtaaactgacttatgataacaaatcaatctaatagctgacagttattgtccataataggactgccttaataggtggtccacttaagtaatggtcctactttaattcaaattttatctcaattcattttcatttaatttaatttcattccaccaaacactattagataagtaaggttgacttactttgatatcacaatttagaacaagttatcattcttacgaggccatgcctaaaactgttagattttatgggctaggcccaggcctcctttgaatgtttacttaccaaaaattggtctagtgattcagtcactaacatcccccttaatgcgtggggattttcttcctgtagccaacatatttcttcatatatccagtagagaggaaaaaaatcaaaaatacctttacgtatagtcgatagggattggcaatccgtaattaaacctataatttttatttaaaatttatatatgaaaaaaaatacattgttagatcaaaattaattattacaaaatttattatgtaaacttatatgtgtaaaaaattttcatatcatgaataataataataaaaaatttataatagaaaaatgatagaaatcattacttggattaatgggtaggtaataaaatgactcaaaataaaatatatgatttagaatattaagtgggaaaatgtctttatactaactttttttttatattatataaatatacatgtatttattttcatttattttaaatgatccttttctttacattttataaaattataattatacttattttcatttatcttatttttaaaaaatttctgttgacagaattttaaaaaacttatactaatatatttgtaaaatctattttaaatttgtatattattaatgcttatccacagaatgaaaatttcaaaaataatttaaataaaataaacaagtaaaataaaaatttatttaaatttcaaaaaaaggaataatatttttttaaaaatgaagagaattaatgactgaaatttaagatgaaagagaaaattttaataaagaaaaatcaaaagtaatttaatctatgatttgattgaaaaaattgaatgtaaaagaaaatataaaaacaattaataattaaaatttaaaaatatattgtaaagcaagtgataaataataatgaattcatgttataagaaagaaaaagaaataatagaggatcttcacgtttaagtgtgatttttcttaataattatagaaataaggtttaaatatctaaactgatgtcaatcaaattacttgagcctctcatcactagctcaatctaagagaacttacatttataaaataataaagtctggcatttgaattggcagcaccgatcacttagaaagttccattgtttttgtaatgaaactatattaatccaaatcctgtgaattcatggaacccctgtattatgtgacatgatgttaggacttagaaccaaatggggtgacattaaaatgttattatgataacctcccaattcatggaaggcaaaaaaataatgggaagaaattctgtacaaagaacaaactgtaaatcaacaggcaaaaaaaatatacagcatgagacagtgaattcacttggtgtagtttataaacaaaccaaaattgtgattgcaagctttgctatatgtggaaaataaattttagagatcacgactgatgaggataactccaatagaattactgaactctccaccagagaaaggactagtaaccataggaaagccatggatgcctcagtgcttgtcttgcagtaggccttcttttggggttgatgctaagtaagtatctgacgaagtcgataaacatagtatcagtgacctgtaggtgctgctccaatgatgactcttcttgaattatgtactccagttgatcagtctcctgtgcaatgtgtacaatgttaaagattagatggaaagaactaaaatgaaatttagaaggaggattcaaattcaaattatgctgatgcatcaaaggcctttatttttcttccctttattgtgcataactagtacttgtgtatattcccctttcatttactctactttctcactcaaaatagacatactaatccatctgagcttttcttcacataaactttacccttctcgttcatatattctgaaaaaggtagtggattttcattggctgcctttggcaaatttgaaattggccacaatgtggtttgataagaatataggattcttttggtaagagtataagatttaatcagtgctcataaaaaaataaaaaaaaatgaagaaagatgtactgcattcttgtgttaattagatcatagcatgctcatacttctagaaacaagaagagaactttttcctgctttttctttcaaataaatgagtcaatatgacctgtattcagaagcgagaagaaagtgtttttttcacctatgatttcattaaaaaaacaataaatcttataaaaaaaaggaacagctatgaagagaaaaaatagggggaacaaacctcatttacataataaatatcatattctttggtgaaatacttgtgcgtttcttgcccttttaccaacatctccatatcaatagaaccaagcattccaatcatgcgtgctagaatcatcacaactgcatcatttggaaacagcacctgcagaagacataagaattccggatgagtaaataacaaaaaattctttgaaattatttttattcctcaattatattagcttaccaaaaagaaaacctgattaaaactatatgaattttttttccatgctcatgttaaagccatagaaaaatgtatttcatgaatatcataaaaaaggcaaataagaacatacttcaccagagcataactctgccaagatacagccgagagaccatatatcaatcttttcatcatattgaaggcctaacatcacttcaggagctctataggatcgggattgtacatatagacacaaattgtctgtttggaagcaactgcttcctagatcaataacctttatctcacatcttctgtaacttttgattagaatgttctctggcttcaggtcacagtgaacaattcccaagctatgcaagtattgcaatgcttccaaacattggcgagtaatgagctgaatgaaaataaggataacaacaaccctgatcatttagacaactctatatctgacaagaagcaattctacacaaatagctgaattaactatctcacaatggataggcaatgtattaatagaagccacatattgctgaggatcataggtttgaaggatcaagggtgctttagacagctaactttagcaatataaagactgaataagtaatcatgtgcaagagtacaaaaattattgttctgtttgaacaaacctgcaatctgttcaacgtaaaatattcttcccctccagattcttggttgaacttctgaaattcgtataggtttgcttgcagaagttcagttacaatgaataaatgctcctgtgaagttttaattcaaggtgaatttagactaaatgggatgggagaagatatagtaagaaatgttaatcataaatttccactagatcattctaaaagctatataaaaaggatttatttgagctcttgctctatagtccaaagtttccctgttaagcacgtattaattcacaaatattttggatatagcttgacctaaacatttcgatcacttaatgaaatcaattcagcagcatatgacatacctgatggtagaaataatcataaaggcgcaaaatgtggtgttgatctgttgggtcatgcttattgacaagtttcagaagcttgatttcatctaagctttgatcaaaaaagtctttgtcatttttaataatcttcaagcaaacatctattcctgtctgaagatcatgtgcctgaacaaccctactgaaggcagctgaaccaagatattctgttacataataccttccagccaagactgtatttagcacaatgggaagttccttgttttcttcaaatccagtcctgtatatgcaataatggacgagagcaaattatactcaaataaataaattatactcaaatacaatgcaagtctatttaaaatacctaaagagccaaagtgaaaaaccaaaattcaaattccacaataaataaatactgagtcaaaatcaccatgcaattagttaaagccaacaaagaaaaagttgacggctcaaaaataagaaaagtaaaagccaataaagttgcatttaatttcaaaatttactaactcgtgatctcctacacattcaaaatcaactcattcaccagcattaacaggaatatttggcagaaatgtaagttcaggatacaagatcatctttcaagcaaacctgttctttctgtgtataattctcagatcaaatacttcgtattcttcctcttgagtatactttaagagctcatcatcagtagtatcctctccatctgcagtaatctctggatcttggcactcttcagctaattctccaccatctcgtgctttataggtgtcaagtccatttggtagatctttttgattaactttgatagttaagtcatatggaccattgtactccttactgctggcatttttagtgtagtagtcaaaactttgattcacagttagctctgaagtagagtcaaaagagttaatgtccccaacaaccttcaaatgaaaaccattcagatggatttccttcaaattagggtagccgaagtttgtaggatccaaactgcaagaaccacctgaacctggactgcttttgcaaaatggaacttcacaactacaggcaacagtgtgtttctcagccttgcactctaattccccttcaaacaagttgttgttatcaacatgacaatactctttcgaataagtaacatttccatcccttacagaggaatgattataaaggcatgccttgtccatgtaaccaccattaccatttccctttaatagaaattcttcagagttgtaaacaaggtccagagaattgtcatgctgattttccgtttctgctgtcatgacaaacttatcttcactttgacacgcaaagaaatctggcccttcaaaactaggagtcatgaaatagtcatcatctttttcattataccaatatggttcattctgcatttcaaaatcatgataatcacgtgcagtgccaaactgagataatctttcagacgaagatgcagagtcattctgagtctgagacgaggaatgaattccatacggatttatgaattctgcaaaaacaactaggttttaggatgctctattctctgagataggtgaatgacaccactaaactaaactgatatttttcggaattataacaaaagttgaatattagcatttttgtgtgtgtacgaaactcaatattttactagagaacaatcctgttcacgccggataggaccactgtgttgcatcccctaagttcagatcataatgactagaattactggatacagcatgtagcatgcaatcgagttgtgatcaacaaaaccaaacactcgaattcaaatttggatgataaatttatatgatccaaatatacaaattaaaaacattaaaagaaagcatccgattcaagaatagtagctgaaaaacacagtaactaactgttaacgtctccgttacttcgaacagatgatcaccaatcactgatcaacacatgcaattgatcactagcactaaacaatttgatttgaatttgaatagtagctttcaactttggagtacctgaagaagaaacacgagaagtgggagaaccgatgctgacgaactcatcggagctggatttggagcagttgccgccggaggagagctcggatggccgggagaaggatcggactctgaccggcggcggcggcgggaccatggggaagaagaacttctcgtagtcgaagtttccgaggtcggtgttctcgatgatgtcttgtcggagagcggactcagcttccgacaagccattcttgcgcagaaaatctaacactgcttcgacgccgttggacacagccatggacacgacaagaccaactcagaaacgttgttgttgctgattaaggagggcagtgacatgtgaattaagaaacacggaagggacaaaagcgtaataaaacgcatggtttatgatgtgcatgctctggtaatggttgcaagagagagaatgaaggtgagattctgcgtgtctctctttctctctctctttgtttttctgtgtaaaacataagccaaaccaggggtgcctatgtcttaccaactttgaaaagagagagaataaaactttgtgagaggttactgtttggtgggtccagagacgttatgaattgttcgatttgacacgtgtagtcatgatggacgtccacgtcacggactgttttttttttttctcttttatggtgagaagtcaacatggcatgggaccatcgcgttttgctttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattgtgattttaagataactatcataaaaaaaaaaaattcacggtttgtaatggaatgttacaatattagtggatgtattacttttttggttagaacaaatgaagataatcaagatatagatagttattattggattatgttcagccgccttaaaaatcttccttataatcttggaatttttatgatcgtttgattgtaaaacatttgaaatgagcagcattcagaataactggaccattaaaaagtccaatgaattaatagaatcaaatcgattgccgacatggacaaaatgctttcataagcaaatgtggctggaggctgtggcgcaaagaaactactccaagaagtggtcatagagattagagagtagtatttttcttttccgttttgcatatatggataactcaccacccgattttagaatggatatgttttggagaatatgttatgatataattatgattgtgattattataaattaaaagagagagagaattcagaaagaagcaaagattaataaaattagtaggaccacacgcacatgttcaatcttaagagtaaattgaacttttttactggtgtaacctacttttgattagggggtcaataatcaatagcttagacccaccatataccataatgttgtttcacaattctatatatgaaactgagtcgccacccactcctttcttttccaggttgatcagtcaccacaccacactcaccatggcatgtagaatcattaacctcttttccctcctttcatttgttccctttacaattattgttctcctcaccctcctttttgttttctttttaacctttttttttcttcttctatttttctctccggccctggacaacatttgaatttcaaacgagttgcccgttagtgaggccacacacgaaacatgccaagttcttaaaaaatatgtcacttttatgttaatttaagaggatgagtgccaggttgtacatatattgcatggttgaagctcaaagcatatagcgttagcttaacttccaaataaatgtaacaggtgaaaaatttagtctagtcagttatgatttgtgaaaaaaagtggtctaatttataacatcagcaattcagcatcaatctttagatttcttctataaattgcacaaaacctagactaaatataggcagtaatccataaatgggatgccaaagttgttggcagtgtcacttcttaggttaatagtattaatatgtaatttcatggtttaaaagctcatgaacttcaaaatataatcaaatagggtgcaaaaatgtaaattttgttatgttacttgtaatgttggaaaagggttattactctccattgtcaatatttgattgcgtctttgtatggacaagaccccgacctaaatggtaaagtataatgacataatccctaacaaaataattgacttttattttctctcccacttttaaaaaccgagagcatttcaattaggggccatgggaatatagtataacataaccaacgtatacacaacaaagaaaaagaaacaattgtttgagtcattctctgtccctcagatccatttgaaagtgaatattttaaagcgcgtagaatcactatttatgatgatcatttttttttggttttattataccataaattaatttatgttgctgataatgggggctttgtgcttagttaatacttaatactttaacagctatcctgattcctgaattcccacgtatgactacactaatgattatcaacattggaggtatcttcagatgcccatgttctgaagcaccttgcggagattgaggagtggaagaaaatagagcaaagaattgatagcttcctaatcccattcaaaatgaaagtgactcaaggaatagtagaagaccaacaaaaaaaaattagaaaataatattgggtaatgattgctgcttaatgtctaatcagtgattacaattttgaggtataattaattagttatcatcatgaccccccctcccccccttcccaagagatgagatcaaagaatggatcactcctaattgacaattgtataaattagaattatgtttatttgcgttttccctaagaaaacattataataattatttaatttgatgaataaaaactttaaatattttttcaacgcgttaatatatcaagttttaaaaattatatatgtaactatacatgtgtaataaaatcacattttttttatacacatgcagaagaaattagatatataaacttttccccaataagttaattcaaattcaacatattgaaatgaaaattgttgaacagaagttttacataaaaatttaagggcgtgtttgatttcattaaatattttgtgtttgtttctatttttatttttaatgataataataaataggaaaaattttgttatttttttatacaaatatttaaaaacattaaaataaaataaacataagataatactgttggtaataaaaatgatttttttccatattttttcaaatcaaatcaacggcaaggtgatgattgagagactgaaggcttaattctgaaggcccaagtcaaaacataaacatttaaaataaataatgccccatgagttgaattaaatattttgagcgagattactattcacattatcagtttctattttcacctccacttgctgaaatttttcttatttctgaaaatatgattctgtcgtacatttcatacttgttgcgcccctctcattaatatattacaaatatgttttcattgcgtatctaataaaagtgtataacaaaaatgtgtttgcctggggtatcttggtgagatacacaagcaaaatgtgctttcattatctcagtaacacactaatagtgggtcgaaccattatgaccacagtaggcccattagaaagacttccagcccatattgctgaaagacttccagcagaaaagaatgggcctttttatcatttagttgttgttgggtttttattacagtttccaccctagctaggtatattaagtgatttgtattcctgatacttattatgaaatgaattatgcatctttttcttagtagttgtagttgtagtgtagcctttaccgtgctttaccctaatttagctagtagcactttatcacatacactatggagtcccatttctgttgtgcacaaatcaacggaaatgtgattccgttgtgtataaacacaagcaaaaaaaaatgcacctctcacaaaggctatgaagacaaagaaataaggtggtggggaaaaagggtaaaagaagtgaagtaggagatgagggtgtgaagatggaagcaggtgaaagagaaggaggaggggtgggggtgagggaaactggcaacaggggtagtttcatcctttaaactgaatctaaaaaagtaggggggcgggtgaatagtagtgtcatggtgagaataacaactccctttttgagcccatgaggcccaagtaagtttcaaaccttccaagttccaagcaatatttcaaatgcaacatgtccacttcatttgtatgtgatggaagccagacgtctcccacatctgtgatttctgtaaccacagatttgggcttaggaatgtgctcctctcctaccagcaatcaatctaagaaaccttccactcaatatacaatggagcctccaaaggaaatctcaagttccttttcttcaaaatttagtgttgctggtggaaatatcttgaaacacatccatcccagccttttaacctttttttttttattaaaaaaatagacttttggggacaagttgatgcaagaaatcccaaaattctttttgatgtccttaacaagaaggttagctggcaagatgaagcctcaagtattatcagcagaacaatagctgactgccatgcaaaaagggttggagcaaatcaaaggggtgatgtgtggatgaattttgtgggacttgataggaatggtaaaaagaaagttgctgtttctctagttaagttcttgtaaggaagccgggataattttattttgtggatctttgttctgaagaaatgagcgaatgcaatgtgaaattcagagggaagactactcttgattttattgtgggtgagttttgcaagaaacgcttctctgtggtcttccttgaaaatgtagacaaggctgatgtgttggttcaaaatagtttgtcccaagccatcaagaccagaaagcttattcactcacacggacgagaagttggtgtaaacaatgcaatatttgtgacttctttctctggtcaccaaacaaaggatccttacaactattctgaggaaagaatagcaaaggtaaaagtgaagcctatcaaaataacagttgaacatgtgagtggagacatcagaagccaaagtgttagtgtggctgatggttcaatagagagcatttccaatctaattttagtaaataaacttaagttcattggccataatgaattttatgatcagcatttaacctcagacacggctaaaagtgcacatacaacatcaaattggtatttagatttgaatcttccagctgaaaagacactgaaatggaagatggaaacttggaacatgcgtcaactgagaaccaaaacctttggttgcaagatttgtatgaccaggttgatgaaacagtggtttttaaaccttttaattttgatgcacttgcggatagagtggtgaaagttatgacaagtagcttccacaaaactattggatcagagtgtgccttacagatagagtcagaagtcatggaccaattgcttgcagctgcatatgactcagacagaggtaaagacgttgaaaatttggtagaagaagttctctgtggaggatttacagaagtacagagaaggcacaaccttactgctagttccattgtgaaacttgttacatgttcgcatcaagcatcaagtgaataccttcttccaagtattacaatggaatgaattcctgttagagaaaatgttgttccaatttggatgtataatttagctgtagcacatagttaaacttattctagcctatacaactatagtttttctgtttttttataatctaaatgaccaagttataattgcaaatactatgtaatactcagctagtggtttgtgtgactttccttgcatagtaaaatcaataatcttctttacactgaaggaaaaatataatcaaatgtcttctagaatcttgtaacaaaaaaaatacccctatttcgacaattttctgccgttcgacttttacaagtgaagaaacaattaaaccaaagactagtcgctagccaaaggacattaaatcatgaatgaatgggatagaatggtatgcagtaatatgaaatgaaatctgcttgattattctcttattcattctaaccctttcagcccttgtatgcttgtacagaacgaaaaatcttactatttgtataatttaatacgtatttttttttttaaagtaatgatgtgtatataataaacaaggagggcactgaagccttacatcagcaacaatgtcaacaagatgtgatacttgtttgagatcatagataaaaacttttttgttacttaaaaatattttaatttattaaaaagtatatggtcaatgtttaataatagatattttttacatgaaaataatttttttcattagtatatataatccaatcatttttaaatatatttaataaaatttaactttcactattttattaataaatttaaaatagggataatgatacaatataaaattttattatagtttgattcaatattaatataattacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaacttatatgtgctaagaaataacatttttagatacaatatttttaggatgtgatttccgaaaatgtaaaaatattccattaaataaacactccctatagtcagttagccacatatctattttttttgactgaatgtatctttcttgtcttgtaataagtgtttatgaattttcatgtcaaattaaatccattgttctcttaattggtcatcaacccaagaataatttttaatttccttaattattttactcgatacttaaatttccacaaattaatgttacatataataatatatttataaatcaccaatatattaacattaattaaaataatttaaaaataaaatataaacatttatatttttaaaaaataatatttcagatatatatatatatatatataaatgtataatttatgagatatttattagtcataagaaaaaatattaaatgatattttcatttttaaacggagtgcattgattaacctcattaaaaaaatgggcagctttcattttcaagcacgtgttgtttgacaaatttttcacttttttgaagaaatttatttccggcgtgcgtgttagaaacaactgcctcaaaaacaaaggcaggtgacggagcaactcaaatcatgtttgtccacttgacacgaactgaagttaccccttatgtctccaaattcttatgcctcgtctttataacctctacgaaatttcattcaaagagcctgtaagctgcaacaaaatttttggtaatatactcttgagacttgtcaaagaccttctaaaagttgttttttatccgtgagaatggaaaacattctatccagataattatgaagaattaagaaagtaatatgaattactaggtgaataagtgaatgtctgtgtgcacgagttctaaaaatggtgcttccttcatttaaagatgaccaatgttttaacattttaaacttttaattgaaaggataaattaaaattttctctctaaaaataaacaaaaggaataaaattatcttgataaaatatgtcatgcaatatgagtactgtagaataaaatatttatattttaattcaaattaatgtaaattgaatatatacatgcaatatgtatattggatatatgaatgtaaccaattagccacttaacttacgacatcatcacttcttttaattcatataaactaaaattaatcaatagaccaacataactaattaattatagagtcttactagtactttaacataattcagctggcaaacaggaagttaacacattagtttgtgatttgagttaggttgaaatagaatcccagaatacattctaacttaatttgtccaacatgatagttaccacccctaatataagccattaaaatttggccactcgatccgttcatgtgcgctgtggttcccagtagggtatgtaaagagctttttcctattaattacttacatcttgtgactgattctctaatgtgatttgaatggctaaattttagacaatgacaacgtttattcaatgaataaatataattaaaaaatatttgtcgccacgaatattttaagaacaaatatttgtatgatattggttaaaaaaataaatatttattgtggaaattatagaataacataaaaaattatgaataataaaatttttcgtctttcaataaaaatatttttattttaaattttaaattttatttttaagatactaattaatatttatctttttttaatgagaaatactaataatatactctttataattcactgaaacttattgaaaattatatttttttatgagttttacttgttatctaatgaatttttttgattttatagtctttaataaattctaattaataataaaataagtgtaaaaaaatgtgttagagagtatattaatgggatttgtttttatcaccagtaatgaaattttaaagtgacatctttctattcgttgagattgatatgtaatcgaaagcgacgaaaattatgtcaaatatgttgttaatatatggcagtggcgctaccttttcaaacttcgcgtaggcacctacctagcacctctattagaattagaaatacgtacttcacgacatcatagacgaaaatatagttaatcaacatatcgctttcatgtcttaattttcgttaaatgtacttaatctgccacttgttccagttcactcaagtggaacaaattgtgtagggaaagatcagaatccaaagaaggtattacttttcttacttgacaagacgaatgaaaggtttaccccgcataaccgacggcttggattattggataaccatgcattatttgtcactcaattttatgccatgatgccgacattattaaactaccattcagatttcagagttcatcacactactataaaaattatattttacgatgtcaaatcaatgatgacaatttttttataaataggagcatacaaatgataacggttgtatcaaaatcgtcgtagaattcactcaccctcatcatggttgccctcactcaactcgtgcccgtgccttacctcatagtcgccaccatcgaagtgtctccattgtcgcgttttcctccattgtccccaaagcgcttcccttatcttgtccctcccttctctctttctccctcttcccaaatccctcatttctctccacgtgtcgtcgtaccttcgtcgttcaagccgatcccaaaacggcgtcgacatcgtccccatacactacgactttgacctcttcaccatcgacgccaacagcgacgacgtccgagccgctcgcttcgctgccaaatacggtgcttccgtcgccatctgcgaacttcctttctccatcatctcctataaaatcaccggaggcgtcggcgaaacatgagtttatgattttcaatgtttttcaatttcgctttttattgaactagggtttgccattgtggaggccagtgaaacagagtttcgtgtttctgaagactggttcggtagggttcaggctaaccaagctttttcaacaagctaatttgtagaagctcatttgtttgatatattctaatggatagcattctatcattggttctacttattcttaatagttttcaatttaatagttccccacttcccatacatctcttttgctacgctattagtccattgttcaggaacatcattgaattataaatttatatatccatattaaagtaaagagctattatagtgaaagcacattgttcccaacttctattttatttattttaacgtgtcctgaatatcagaattggtttctgatagaacataataacattatttgatccatttagtttatctactgggaagggcttttagggtggtagtttgtatattttgaatgcccctctaatcccatatatattttccaacttttttgcacttgataactcttgaaaaaagcttcaggtgtatgaaacacatgcccgattggcattggaatttggggacctgtttgagtataatcaggtttgttctgtatattttttttgaagaaaaaagacttttatgttttaattcattttagtctttgattgcttttttttactcgtttttgcttgttatgcatttgtttcatttttttttcctgagatcaaggattaatatacttcattaaaggcaaccaatgctatgaagtggtgaattataacttcaatcaacgtgtaaactttggtcccatttttgcttgttttggaaataggaatgatttattatagaagttgaggatgttatttgtaattggactttagatattgacgctatttgtgtgaatgtagtgccaatctcagttacaaactctttatgccggaggcattgaggggtccgatatggattttgctgcttacaacttgctgtgtgtcataatgcattcaaataataacagagatcttgtattatcaatggcaaggttaaccccatacttacatgcttacttgactctcttttttcaaaaaaactgttagaactgaattatgtcatgtgattcatctatttgaatttcgtgatattattgttaaaatcttcattgttgaaagttactagattgagccattttggagttatattcccataaacatgctttaataattatattatgtttcacctatcagaatatttgtgctaatattattataatctgcactgttggaattttctagtttgggttctttgggagttctgttccctgaaaaatacgttgataatttggaacatgttaatgagaatttagaaaatggtttgtgagggaaaggctcaaattggtggctatttgggacctttgggtccttgggtggaaatcagtgattctcaggtcctgataagaaaaatagagaattggatcaatatatatcaagtctttcaatgactatacataaatatatttccttgaattattgtgataatagtataatgatgtagtctcaattattttgtcatgttatcatagaatgtcatgaatttgaatgtctagtgtttgtcaatactaggttatctcacgaagcaaagaaggatgaagctgtaaaacatgcccttatcgtttgtgctgctgtaacttcaacaaattatattgcattctttagactgtacaaaacagctcctaacttaaacacctgccttatgggtgagtatttttagttaactggtttttgtagcttgttagtaacacgtaacatatatgtcaagggggataaactgaaatgatttttttaatatccacaaatctctatgttgaaaagatgcgttataaggatgtgaactacatgtgttgatcatatcgcccaactctacctgtttcatacatttataaggtttttgggttttcaactggcgtggccacaaatggagcaagtgatgagagagacacagatgcattggaagagtactcagaatggttgaaagcacattgggctagcataattactgataacaacggagatatgctgctagatacaaaagtatgtttgatctctatcctttgtattcattgtcttgtaggtgctaatctagtcaaaaaaatttgttctcaagcattgagcattttgatttgttgaatcatcactcatcttaaggaccatttacgtttgtgctgacttgaatcactacatttccttctgccatattttgagagttagtttgattttctctatgaattggttaaccgttagttaacccttacaaatctaaaattccctagttactagtcaactttaacaagtgttttcttaaccaagttaatggattgtggtgtggtgatttaatgagaaatgtttaattttataggtttcatcatctaatctgtttgtgccagagctagaggatgttgttgttgttgcaatccatcagaatatatcacttataagataggtatgcaaccatagatgatacaaatactaaattgttacatcttaataaacattcttcacattcaaattgtgaactatgtctgcagattagagattttgtttcagaacaaacgtttattaggaggtattgaatttcatactgaggagtctcccaagctatcacaaagtcagctgatggctcattctctttaaagaaaccagtcggtgtctcaaggtaaggatggagttatgtttcttaaaagaatacaatttttacttaggcacatattgcatttaattttttaatggtgactaaggacttcgtttgagcagaaatgttgatttcatctttagttcgccacttgttattatgatctcatagtcgttgataatgacaatgcattgtgtatagttaacttggaaatcacttttgttttgagaactccatggtattcaaatcttcctacattaattgtcttctatatatttatatctatatgtaacatgtatattggagtccaattaatgtaaaagatgtaaacaaaagtgaatgtgagtgatatatacttgtagaatatacaaagcatatcattatactaattcttcagcatcttaaatattttcggactttttggtaaaaaaaagagagaaaataaaattaggtattaagattgtatgcataatatagaaatttataaatattatatgttaatatgagatatcttatattattattattattattatttgtaatatttacactaaagactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgttgattttcacgatatcgaattcaaagacgattaaaaatcgtcataaaaagtattaaataaccgtttttgaaagacttttttgtattaatgatttatatttcatgtgtagagtatattaacattaatttccccttctttagacataaagattagttacaatgacactgacattttttataagaaccttttcaaacatatgaataaaaagataattttttccttcataataattttatttaactcaaacaaaataacatttttataaaagacaatacacccgtctctcttttataaatgtagggtattcttcacctaagagtcaataatgattacttaatatcttaagttattaaaatttatttaagaaactgatctctgtcatatttaaaatacccgttaagttgtgtcaattgtgtatgattttgtataaagctgaaaatgaattaagaagaatcgagtttgattcagctcattaatatttagtttagcttgaaactcgacttgagttcgacattaacattttttagctcgaactcaactcgatgcaagctcgtaaacatttagctcgaatcacatgaatcaagggtcaattttgtttaaatcctatacattttaatttttcaatttattaatagattttagataaaatgattgtttaatttttttaaaaaatggaaaaactaaacttatcctattaactttgtaggaccggtatgccaaaaaaagttaattacaaccaaagtctgcataaataaaagttatctcaccttacacataaaataatagaaaacacaactaattatatatatcgagtcaattcatgaactaaatgagttgaacttaaacttcgttcatttaatgagctcaatttttaggtcaagtttaacttatttggttcatgaactaaattcaatgaactaattatcaaatataattttaaattatttttgagttggttcagttcattacattcctaattttgtaggttaacaaaatttcaattttaagtaaataatttctttcagttttgtttgttttttattttattttttatcctaagaaattttattcttgtttttctcccgtcctttcaaaatggaaatttcatttatgaagtttattttgcatgatcagtataatttttttacactgattagaaatttttatagatataaattttaaaataattattaaaaaatcaacaatcttatacatgataatttattattaaataacaacataaaaccttttgcactacgatattttcaaattaaatccttcatttatattatttatggattacatattctcaaacaagaaaattgatcattgacatatttattgagacaacaattgcattagtactagctacaatgattatttaattataaccctcgtttgaaaggtactactactagtaatgataattaagatcccccaaaaaaacatcatcaatttctctccaatggaaaaagaataatagtagattatatcataattataagaaaattgattgtaccgaatggccctattcatgctttgtagttcattggggacggagtctacggtacgacaggaaaactcctgcgtatcgtccaaaaggaaatggtagtcgttcgattgggggttttttttatttttctttttttgttgccatttaccaaaacgccatgatcttcctcagcacctccgatcgtacaacaccaaggaccgagtcccttctctcttcttctccgaaccccaccagaacaacagaaccatcgccgccgctgccgccgcatcacagcctcaataacaccatccaccatttaccttttcctttcaccaccctcacaaccgagtcccttctatcttctctccgcgttccgacaccgcaccctcgttctctcttctccaccgagtctatcgaatccacagtggcggtgccaccagtcttcttcaccaacagcttcaagatgcagccgagatcagcacggttcactttgcgatctttcaccttctgatctttcaccttccagaaccttccaaacaatttctcttctgttagcaaaaaaattcacatttttattttttgtcgggatggaattttcttgcttttatattttctctgcttcatgtagttgggggtgtctgtgagatgaacatgtaaagttgagattttttcaattatcttcaatttagcaagtttaattatgttccatcaaaattccccttatcttccagttttcgatctctccaaccctttcacaaagatgcttccttttactggttattcagagaatatttcaatttgaactattcattcacatgcttgtgacaaatatttttgtgtatgtgggtgtgaatcagtgagtctggaatatgctttttcatttttgttttttctgtgaagagttccaatttttttttgtcaatgcttttaatcaatagacgagtcagattccgtcgtggtcgacggttgcagagggcaacgacagtgacggaaatggggctggaacgcagagacgggaatgcgaagagagaagaaagagaaaaaagaaaaaggttagaaagggaaaataagacaaagaaaaagaaaattaaaaaataataactatttgatgaaaattaaaattaatccaacggttaccaatttctctcgcacgatacgcatggattatacttgcgtaccgtatactccgtcttgattgggatgccaacattgccgaaaatcccatccccaggagacaatggcagtacactaatattaatggcccttgaaaaagcacttcaatattaatggcagtacactcatttttgcttaattaaatcgcaagtaaaaatgagaatgctctctcaaaagtgactttcacatgtgcgtactccacccaacattcccaaacaccccccatttgccaccatgtaacaactgtaattaaagctaattcaaataaatacatcagctgtcacgatttattatcagagttcaatgctgatgtaataataccgtaaaacaaagtttgtaattagataacagaataaattagttttatgcaattatgccccttttcattactatgttattatatatagtatatatttattggttattgttgatgattaatttatatgaagaaatctgatcatttttaataaaatttctctctccaattacatttttcaatctacaaaatttgaatcaaaaattttacttttttttattgacaaatgttaatttattaatttttgttaaaatgtctaattgaaagattcaaacacaacatctcttcagtcttctctctcttcttccttcaccattctccaagtagtgagtcaatatcttatatctctttcgaaatcttacctaaggaaaacaaatttagtattacttaaatcaacttagattagtgatttattggtattaatgtattttctcttattattattattattatatggtattatcttttttttttctctccagcctctcgaaccacgtatgatcatactattaatttttgggcaagctttgtgtgattgtacaaaagctttttcaactcgataggttcatgataatgaatgcggatctaattttggagtctgagaatcaaaggaaataaatttgtgttccctgcaagtttcgaccatggaccatcgtggggtctcactagtcaaatgcgaggaagattggtcagtggcagaggcattagagtggtagtttatttctcgacccagcacgttaaggaaaaaatattatgaatcatgggaatgctatgctgctgctagctacagtcattatgaattagatatgctatgttctttctgtctttgggaaccatttggaatccaacaaagtaaagagagaaattaaaatggcataaatgaaagaaataaataatactaatgaaaagggcatggtcaactccacacactgcaccctcttctcccaatcttagttctttccaaatttttaaatatgttccatttgtggataggtatagttggattttaatgtagtttaatttcatcgttccacaagcaatatataacagcaaaacttgctcacttgatatgtaataaaatgtatgtttgatttaattttcaagtaaaaaagtatttttgagagaaaagtaatttttctaaatgatcatatttttatgtgttacattagtattagaacaccaaatttaaagatttcaaatcatgccaacgaaaattgattcaattgataggaatataatgaaaatgcattaatttaataattttggttctgtttatcttattttccataaataaagttgtagtattagttacttgttaaatccttgcatgagttataaaacacaaaacgagcgtgaaagattttttatccattgaaacaaacgtccgtcgaacgttaaactttattctagaaaaatcaaatacacattagttaatcataatattaacttctgtagaagtttgtagcatatctttgcatctttaaataatttattaaaaagaaaaagtttcgaaccaattaaacgatcctatcatgtatacgtaatcccaaatgagcaattccagattagggtgactcactgccactatgagacaacatgagtggcctagtttgattggatggagaaaaataggtaagcaaggaaaattttcaaatttgaattgaaaaaaagagaaatttaaaattttctattaaaaataattttttcttttatttttttcaaacaaaaaaatattttattatttttttttccacccactttatctcctaccaaataaaacataaaagaaatcagacaaagcgtatcactttacgtacagtttcaagcacgtgactaaaaaatggttgtgatttggatatttttttatgatgacaaccttaataaatagttgacaatactgacttttgagcatgatggggctctagaatattcaacacagttacacttgttttattgcgagataaagctcactcgtgacattaggcaagcatgtgggttttaatttaagaacaacttttgtcaatactaagttaggagcagttaataactcaccttgttgagcagaggttaattcaacattagatattaatttttttttatctatctgaatcaaagataagtattagttaatttatacaaattcacacaatttgattaatcaattgaattaatttttttggttaaatagagttaaaagaaccaatctattaggattcatgagaaattattatatgatttaaaactattatttatttatgattatagtcaatttttatattgtataaaatcaaaattttaatttataagaaataattaatataccttaattacttgttaggtatacggtgatctagactaaaattatctaaaaacaattcttatttcatgaatccatttccccccaaaaactgttgacaatcaactggagaatcgcgctgtgtcatacaatctatattattcatcgagaatctgcataaaaaaggaaattcgacaatgaagaaaataaataaaagatatgaaaaacatttgtcttgtatcaaatgcaatggaggaagttcgacattccatttccacgcattaaaaaaggaacagtaatttctttaataatttgcataactatgataaagaaatgacacgtgcatgaaagcgagcttcaaattgtgatatttagaatcagatacaccacaaagataaaaagctatatgctcgtgaaaaaaagtgtcaattagagttgtcattgttgacaaaaaaaaattctattaaaaattgatcgaagtattagtattatgaatttaaattaataataagttgtgtcaaattaagtattcatcccaagaactaacacggacctataattaatatatatatatattgataattgtatatattttggttaataaaaataaatatttatcttatacaataaacacaaattaaaataagatgattaactaagcttttaattcttaatttttttaaattcaatatttagttcctaaataaaagtttgattatttaaggtctcaatttttttttattaggagtctttggatacaatattttttttttcatgtcaagaatcatcatttctaaaaattatcaacttgagaatcatgatttctaactatacagtaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttattacaaattttattatttaatacattaaataatgagttaataagaataaaaaaatatttttattgtagtaaacttgtttttaaattcgaaaaagttagattttcactttttttcatgaaaatatttcctggaaatgttaatttaaaaaaataaaaaatgaaaaataaacattttcatgaaactaaaaaaaattcttgtaccaaggcgtccccttaatgctttttgtcattgaacaaaattttgacctgttaaattctcaaaacttttttaaaactttttgttgaataattaaaaattgatttttaaacagtttaaagacattgattggttaaattttaaaaataaaaaaacattaatccgtcaaacttttatttaaaactaaaaaatcaaattttgaaaagttaaaaaactaaaaacttaatcagcctgttaaaatactagtattcataaaatgtgacacatacaaaagatattttcacacttttcacagttagatcaatcaacaatacatctcccccggcctacccatatttcaatcttcaagagattactctcttttattttatacccattctttctttctttaattttttttctttttcttcctataatgcaaactcaattgtgttattattgttttagacggtgactcacgagtgtatccactttagataagatcatcaggtgtttgaaatctcccacaaacccgcaagcgtctcaatcaaagtattgtgctatgtttttattgttattattttctttttaatatattaagtttgttaactagtcttgtctaaacatcttgttctcatgattaagcattgtgtttttttccaagtgcatgaatgtttaattaccattcatgcccacgtgtgtgatgaaaatatcctgattgaatattgggttcgtttcatgagagtttttttttcctaatcattgattgatatagaaatcaccttctgtaaattaaatcagagaagactttaatatttacttatttcatgagattttattctaattgattgccactctcagatgattattcatgattttgggtggcacactggaagctcaatgccatgaaagcgtggtagatctggtttgaggccatatggaaagtggtttgttggcatgtgatagattgtgctcattgcgaaggaaagatcaagttctgacatttctgttttttttaatgaagggaattacctaagttggccaatcttaaggaactattaagttagttagcagttcaaaattaatactataacataagtattccactcttcctttgttgcttacatatagcaattcaaaatccctaatgtggagcttttttaatcgttaagtaagtccgtagtgataaaatatagaattttgcttgatacgacaatctatagtgttggtttgcttgataaaatatagaacttttttaatcgttaagtccctaacataagtacgtatttttttcttagctttttcgccccacttggtctatatctttcggtggttacttcatatttatcattctatgttggtaaatatttattaaccacatattacatgttggtatggggctgattatgtaagttttatgggtacatcttgtatccctttgcctataaaagaaaactgacaatctatagtatgagaatataaatattattcttttaaaggatgagaatacaaattaaataatactctcctaaaaaaatatttatgtttaaataatgccagagacaatgtggaaagaaaaaagtagtggagttcaataattaatttagtgcattgaatttgaagcatgcttgtcaagcattgcatcatacaattaatatagtatatactattactatatgatacaaatattgcccctaaaattatggtgcacttatcaccgtcatctgtatgtggggacacaaatctctaataattactcagctataggaatgatctttttgggcctcccaaattcatccattaacataaacagttttaatttccacatcaatttcatatatatatatatatatatatatatatattatccaattaccctccctcgcttttgtggtttaactaataggtaaattgttcagacaagtaaatatttaggtacaggatttacaatactattaattatacaatattgcaagcaatataatgtccttgttgataacgatatatcgatcatcttggagattttaacgattccacatgagattttccgcatggtcctctcaatctaatgaagagcctgtattcatcaaaggtcatgggcgtgtagagtgcaggtttgtctggctttaccaattcctttgctggctcaatgggtatgtcacttttgggattgtagaagaaggctagggaaactctctctttgtctgaatttactagcaccctgtgctccacactcttgtagtttgcattgcttagaaccttgtcaaacaaaaactaaaataaattagtatgattttcacattgataagctacatactaaagatctaaccttgaatttcaactggaagtaacatggtcgtgcaaacttaaaatcggagacaaagatctaccttatatgttgtaccgcgacgttgcttaagcaaattaaagcaaatatatcccctaatctataattattataatgataattatcttatttagtatacatatttattatttccaatttatcctcaattatattttttcattactatctatctagagagaaaaaagtaaaaaataatattatcattctcaaaacacgtaacatacttaattgtctcactattatacaaatctcaattgttttgtaaacagctagacacaaagtgcctcatttttgcccttagtcttagcttatataatgatcttagcaatatcagtgtcacgataacgtcatgctctcattaggtgtttatttgcatgtttattttattttgacttagttcatacatcataaaactttaatcaatgtcatgtctattttgaattttttttattaaatataaataagcatagattataggtatcttaacagtactcttttagttgaagtctcaattattggagcggctataaccttttttagtagtcaacataatctagatatatttcatcttatacagatagaaataatattttactaggtgcaatgtttggtcttttgaacatcatcaaaagatgcaattatgtactagctagttataattggtagataagttatcattgctttatatgatgagggtatgattggtcatgacgaccactatgaaggatagagtttcagtcacaaacttaggaaggtaaaagcacaaatgagcttaggcaatgaaatcatttgttcagaaatgtcatgccaataaagaacgaccttatccctaatgccgtggccaacaggccaaatgtttatccatttttatttgtgcgagctgattctgtgacagtgaaaagaacattctttataattaagatctctttcaagttcaaatcaaactgtcactaataaaaattattttactactaatttataataaaacatttatcaatagtttctattattaacagttatattaacaaataattttattagtatatcaaattaactaatacacatgtcatcaatacatcatattactagctagtacaatatacatattttactctattaatgtatttcaaaataattatactaataatttaatttccattagaaaaatctacagtcacgaaaactaaccgaacaataaaccacacgtaatccttggcttgactatgatgtcagatgtgaaaactaaaactatataattaagaatacattgttccttcccaaataaataaaataaaagttaattaattataggtttatattcgctatataatttttttacactatcaactaattagagatgactattaatatgagttttaaaatattaaatacaaaattatacaactaaatattaatttataactattttacagtatgttcgtaatatatttttctaatgtgatacatgcatccgtcaaaaaatccgaggaattaaggacaaactaaaaaagaatcaaccctcaacttgaaatgtccgctccatgtgacagatgcatgtatcatgaatttgtagccaaagattccatgaggatatttaagagagagagagtattcacctgaatttggtctccaatattgagaataaaagcatggcgaaggggcttcaccgtaatccaattgttgccttttcggacttgaagaccagggacttggtcgtcagaaagtaaaagtgtcatgcctcctggatctgagtgcgaagacaaacccagcgtcaactctggccttggacactttgagtaaaaattcaccctcatgcatgctccaacatcttctcctccaaaagctttctgaagaacatcctcttccaatccaaggtttatggatagaaccttcatcaacctcccacatagcttcaccagctctctcccatactcatcacacacttccctgcattaattcaagtttttatataaatatatgtggttgttatcttagctagggatataatatagttaataactttaaaattttaaatagttaatttatgatatatatggtattcgagtctcttgtattcaattgtaatctagaattcaatcttcgtcaatctcattcttccaatagaaaagcaagtgaatttatgcattattcatgcatgctttgtgtccaaaggagtcttgggtgatagaacatgctagacatataatataattaatcattgatgtatatatcattatggtttaaacagtttgggtaattcgatatcataaggattatataccaaaaggcaagacatacaaataagaactcgaccacatatagtaaagatatataaataaagagtttaatttttatttatttacgattttaattatactgttaattaagagaaatcatgacacaaatcacttctaaatttaaaatatattttttttaagaaatagaagtcaaataaacttattataagaatatatggtaatgaactagaatgtaaaaactgataaacttaattaatcagtttatagacaattttctagtaagaattaaattcattacaagtttattaaattagatatgtacctgcaagagggaggctgaatgggccatttgttattgtccttcaaagacaagggaaggtaatgaagataatagtaatcactccagtcaagaatggcacctttctgaatcccaagcctgctaccataaccttcataggtttttggcgagtttgcatactgctgcttcacctccaaaggcatgtgaaagaactggcgccaagtttccctagccatgtccatcagctgagggttaacaccatggtttacgatttggaagaagccccactcattacaagcctcagagattttcttcagtgtggaggttcgagcatctgggtcgctaccataaagccctgcaaggtcaatgattgggatgttggcatcatcaacagcaacggcatcagatggacggtcactgaggggtttgatatacctctcagggattgaatctgtgcacctttcggacaaggactgaaccctgactattggctcaggccaatcttgtgggctattgttttttatcattttaatttttaactacacagtttttgttttaggcttgttctccaaggtactcttcatagttcatatcatggatatatatatatatatatatatatatatgtgtgtgtgtgtgtgtacagctaaagtactatgaaacaaaacaaagggtgttgattttactggaacagttggggtccgtggagaagagggcgagtcctttcgaagtgttaaagttgtatctttataatttgttgtgtctttataatttgatgatcatgtagaaacaatttctttacatacttaactataaagctgaatacaatatcattcctcagaaacctatgaataatgagtaggagtggagccagaaatttttttgacagccaacataaaaaaattatatcataaataaaagtattctgaagacaatataaatctaatatacaaaaagatacaaatcgcaaatcacatacagacaaattgcaaacaaggtgggttgatgaacaagttgacaaagtttaatgagtcttaataaaataattcataatttaaaatcaaactcaaagtaataatatgaagataagagataaagaagacacaatcagttttagcgtggaaaattcaattggataaaaaatcacaacgtccaaattggataatcaatccaatggacaactcactatgatgataaataagtacatttaaattctgatgaagagttaaaaattagacttgtcaaacgcttttatatgatctcataacaattctctcaactatgaaaatataaactctttaaagttcttatattatttggaatgaaatgcatactatcaacacaaaaacatgtttctatttatactaatttaagcatatgattttaaccaatttttgaatataattctaaaaatattttatcataatacaatcttaaagatattttatattatacaataaaatcttaaaaatattatgtcctattttttaatataatattaaaaaatattttatcctattttttaatataatattaaaaaatattatattttattatattatacaatataatattttttattatcaaattatttttttaatttttaattttaaatatatatatatatatatatatatatataataaaatttatattaataaaattttagaggagacccaagctaccccctccctcctcctctgataatgagatagggtatgtgggtgttagatataaaaagggagaggtgggcgcaatggggcatggggggaaatggacttgaatatgaaacgtggaattcgtgggggtttaataggtgtgaatgcttcataagttaatgcaaaagaaaaaattagatgagacaatttagtgggtatttttttgcaaaggtggggttggcagcaggtctccttgaagttgacgtaaaagaaataaaaacagcatatatcaaatgtgaatttattggctccagttcattttattatttcgaaaatgtttgctgtacatcaggcttttataccttatttttaaaagaaaataaaaagataaatgtttgagttagaataataattgtctttgcctttcagattcagtagttgaggatctataaatcatccgatcaagaataataattgtctgtgccttttaaatttggcgctggaaaagactgtgaatcgtgctaccctaataagaatcaaattatacatgtggattaaaatataaattatacggtaactaacactcattcaattacaatttattatatatgataaaataattattttaaaataatgtaaacagtgatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatctctttttttattacactatatcatcaatcaaattaattatttatattttctttttctttttctctcaagttatagaaaaatcaagattgttcaggaaacattttttaaacaaaaagtaagaggacaaattaacgaaattgtgaattaaaacaaaaattgtactataaagtaacatgtcatgtatattgcttacgttacatatgactgccaaacaaattattgatgtgaacaaatggattatcgatcactaaataaatattataagaagcataatatatatcatgtttttggaatcttttctataagaagccacagaaaaatattatataactaaaaagatatttatgtgtttcttaaaaatatgtgagatgtagcaaagaatgatataagacacgggttaaattaatttataagttactcaaaagtcttaactgacatttttaattaattgcagaagtttgataataatattttcttgatacgtagtttgataataatattgatctatagtaacgtacagtttatattattatctaaaaaacaatttatattattattgcaatatacattctacaatattaattaaaaactagctagcaataggatgaatatggccacacccctcatcttacaactcatgtcgacagatatggattgaaagggatagccctattccggcgccgagcacaacttgatcattttatgctttgctattttaatacatatgtctaattctgaaccagaaaaattctgagttcaataatcttaattataagccaccaagatttgtagccttgctttcactgtatggaaatgtttgaggctgggatttaagttgtcccgaagtgtttgttgggacttttattgaattggttcatatgtttcttctttttccccttctaaagagcatcaactgtttgcgtatattaggtactccctatatgtctctttgttttcaattccgatccagtgtttagtggtaacatgaaattaatggttttgtttattaaaatcttaactgtaattttaattctttaaatattattaatgtatgattttagtttctctataattttttaagtaaatttaataaccattttttattattaaaattatgacctttcacgacttttttgttatttaaaattctcatttttttattttattactcaaaatgataataaattgaattgattaaattattttaaatcttagattaattgcatatacatataatctaaaacaaagaaaccaacaaaactataattaagtcttaaatcttctttcgttcaaaacatactaccaaaatatcatattttttctcaaaataaaaaatatccaattttcctctttttcaaaccttaatctcaattccttcaaaattgttcaaattttaagaaactttcactaaatttatgacttataaacattcaaaaggattttatattccaaattcatcataaattttctagtatttaaatagaaaaaaataagattttaagaatgttagatctacaaaaattgacaagatgactatatttgttcaatataaaaaataaagagattttatttgctaaaaaaaaataggaaagaaaaattactcataatatttaagttaaagaaactaaaatgaaattaagttaatcctaaatatctcttacatgaaatttcattattttcatatattaattacttcactttatgtcttttaaatatgtatttgtacatcattatcactcttatccctttattaatttataaattatgaaaataagttaggtataataaaaatgaatagattagtccgtgcaaattaaaaatagttaagaaatattaaagagactaaatgaacccttaaacagtgcaatatttggtataaatacaaacagaattggccttaagggtccgtttgatcggagagaaaatagaagaaaagaaatcagaaggaaagaaaacacgattaacgaaacattttcctctgtttgtttgaagaaaaaatagaaaaaaaagttattttttagttacaaaaatttaaatttttccttcttttcattttccttccaattcaaattttaaaattttccttctattttccttcattccatttttttctttcctaaccaagcatagggtaagatttggttggaagaatttatttacaatttgtgtgtgtgtgtttatcttatggcataagtacatgataaagaatgtggcgattttcgcatgataaggaggcaggatgatttaacatttcagactctagtgatggttctttgtcttattaggccaataggcccaatgcctatctattgcaggctgagttcttttgttatggagggacattgcaaagtggaaggtgctggaagactgcctcctaattggtttctgaagacaaggattctgattttttgttgtggaaggcttccctttataagattgtatttttcaataaatttcagctaacaataattagtttaaagaaattattagagagtatgttagtagtatccttttacttttattaaataaagggatgagagtgataaagatgtacaaataattaaaaaaaaacaactcaaaatttaccacgttatttccttggatttgaattccctaccattttaaattatgaattaatctttatcttgctggagaaaaattaaaatggagagtaatcattctaggaacttgtgatgtgaattaaaatgcttatgttctttcacgaatgttagcttattggatcttgacagagttctgttattcttgagctacttattctttacaacctaaattttgcatcggaatggtagtttattagttcttgacacgtagttgagacaatttttggcaacattagaagaatcaatgccttgtgtcgcgtactagaaagggttcgcttgtaattgaaatgactctaaacacttataaggtgtggtaaaacacaagctcattaagagaaggtaatctaattgcacttagtaatttatgtatgccattattatagaaagatacaactttgaaatgaagggaatgtcgggaaacattgttatccagattagagggttatgtggcggaatggcggcccaatggttcctataggtagttgactcctgggataaactttatacaccagcagaaagactaatataccagtccgcacagtgtagttacgaaaataccttcactttattgcaggctttatacatacggattcgcaaatccgtaagattcttacggattcgcgaatccgtaatattttttttgagttatacggattggacaatccgtatggaccatacggattacccaatccgtataaagtaattttttttttaaaagttaaaatatatttttcaaaataatggcacatgcaggtctcgaacctatgaccttcatgttattaacacaatactctaaccaactgagctaatacatcaattatattaaaaaataactaatgttgatacatataatactaaattttttaatgtatatttaatacacatatgattttatataataaattttgatctaataattaaagtatttttttacatataaaaatcatagttttaaattaaaatcataagtttaataaaaatttgcaggtctaataaaaattatatttgtatttacatgttaaattaaaaatcatatatgtatttacaatttattaaacttatgattttaatttaaatttataatttttatatgtaaaaaatactttaattattagatcaaaattaattgttacaaaatttattatataaaattatatgtgtattaaatatacattaaaaaatttagtattatatgtatcaacattagttattttttaacataattgatatattagctcagttggttggagcattgcgttaataacgtgaaagtcataggttcgagacctgcatgtatcattattttgaaaaatatattttaactttaaaaaaaaaaaactcacttacggattgggtaatccatatgggctatacggattgggtcgtataactcaaaaaaaacattacgaatttgcgaatccgtaagaatcttacggatttacgaatccgtatgtataaagcctgcaataaagtgaggggattttcggaatcgcactgtgcggactggtgtattagtctttctgctggtgtataaagtttatcccttgactccttcgttgaatgagttggtcttggtttatagagtttgttttgggagtttagcaacccacgtgcttaaatttgtcaaggataatgtttaaggcacgttagtaaaataggcaaaccaaaaaaaaaaaaatgcatgaagtacattttgtatcttcgatatgaaataaacgctgacatgatcggcataaagtacacgttatgtgtaatcgttaaattttatgcaaaatcgtgctgtaagatattaatataatatgtatttttttagaaattaaagataatgttagaatttataataatttatacacttttattcaactaattgagctagatttcattgatatatatatatatatataataaatcaagagataaataattgaatatgctcttattgtcgcattttgtgagttatcttctggacttatttcaggaagtataccgccaaatgaacgaaaactgtgtaaataaaaatatataatttatgccgcgcaactaaatttaaatttctataaacaaatataaagttaacctccataaactagagataaacttactaatcgactagaatatgttatgatgaatttctgtgttgtttctctagcacaactttttaatacaaaaccatgacatattagatctgtccagttaagttcataaaaaattgcatcttcatgattctctcaaatgaaacatggacatattttttttaatctaattccatcattaaataattgttaacatttagtttcgaggaaaaaaatattgatatttttcacattttattcgtgatttaaaaagtatcaatttacctgaaaatgcattatgcagcatgaaacttattgaggtttattatattattataatatacaaaattatgtgatgtacacgataattaaattaaactaatatgtgcatcagaaaaataaaataataataacacgcaccacgttggaccaaatatgtttacaaacagtcagtaagtgatggaatcagctacctttgcaaactgcgaggccagttctccattccagaacttcaacttcgaaaggaaatgcataagcgtatggatgaaaataagaaatgcaaccaatcataactgccaccatttacgattttccattcttttagcgagctcagttgccatggatgcaaagtcttgtgccccattttgcaactcctcagtacgttcgttgagtatctagtaaaagaatggcaagacatggttagatagaaaaataaaacacgtatttgggagaattccagctaagtttcaattcatcgtaactaaaaaatactttgatttctcatacagctaggtgtgtaggtgtgtgggtgtgtgtaagaaatgtctgtttttagaaacttgataaaaatggaatttctttttggtgattcaggttttatgttctttgaaaaggagaagtttgaaattgtcaaaaataagatacgggtaatggattaaggaatcaaacaatcatctacctggagtttttcttgccgctctacaagtttatcccttgcaagtgcagctgctgccgaggcatcctgacaccagtgaaaagtcaagacatgatctaaaatgagtaaattacagaattttcagatctagatttacccccgtctttctgtatttagccttaatttcctcagctgttctagcttttggttttgagtctgtgctcgcttcttcaagtaatttctgtctgtctgttcctttccctttatctgcaaggcaaccattcaatactcaaaagataaaaccataaaatacattttggagaaaataaaacaatatagatgtacctctcttgtcaatatcgattttctgaggagatgaaaaaactacaggttcatcaatttgaatgtcatctgcaaaagataaggtaacattttaagaaaataaagaatagttggcagtagaaaatgttagggacaaacctatgtcaatcgcaaaaggatcttgcttatctactgtgctcgaggaagactttaagaaaggaggactggagaataattgttttaaattttccaatctattagtatgaactgcttgatttgcattctgatccgcattccccgctttaaagttcttagctatattaagaaagatgacagatgctccctatagcaagataagttgaattacaagtcctgaaaaataatgggagaaaaagcactgcaagcctgaacaaactagacctgtctttcattttgctttggagatagacttgctgtagcatcaactgcagctgcaagaacttcatcatgaagacaaggaaaagactctggagtcctacaagaatttgaaagcatgttggaaaccaaatttctaagtattaacgagacaagatataattttctaaaacatttttttgtagagaggctgatcacattcagcaaccacctgtgggttgtcccaggctctcttcaaatttgatttcatttaatttgtcataagaagctttgctatgttgaaacattttattcaatactttgaatatgaacattagtgcgctaaattgtggggttgagagttgatgattaattgctcaataaaacatatatggccagaaaagggaggaatgatgttaccagaactcattttcacagttcaacagtgatatgcaagcagtttcattcccgttgacctataaaacaagatggccatgagtttgattatgcatgcaacattgttttcttgcactttctgtgcataatccttttgaagaatcgaaaacacataaaaggtaaatgtatggtggttttaattattttttcctcaaagcagaactattgatgttaattgtggattatcatgaaccgactctcccaaaatcttaagctgctagatgaaaactcacaaatggttgtatatctaacacaccctctcactagccattacttgcagcatggatatgcactagcccacctatttggtgctggaattcaattttttccaataccttatgatcaagttacactatcctctcctcccctctattcttaaaaattacactcccctcacttcagataaaaatatactgcacttcattttgatgtgaacaaacctcttagtgttggtgaataactacaaatgagcttttcaatggcatttttcctctctaaatttcaatctcactgaattaattttaaacatcaattgatttttataactatattatcaattttaggaatttagaagatgaaatgaaattttaaacacccctacgattagttttggaacttcatccagaatctcaatttcatcttttagagtcccaaagtcaataataaggattcaaaagtagttgaagatgttgagagtcacagaaaaaaatcatccataagaagctcattcacataaaaatagattaaagtgtgccatatattaatttatcaatgtgtaatttttcaaaataaagggaaggtagtgttatatatacatctcctagacctagaggcaggggcataattttttttaaaattattcagaattagaacaatgagggcagcaaggatcaaacttctaactagttggttatagaggatttgacactataactatatatgagtgaattttccctatagttcaagctgttaggtgaaagttcatatacagttttatatctaacatgaattattcaatgtaattagatatactatatttcaggagttgttctagtaactggtacaaggcatgtaaagtagttattttagatcattgttaaactggaacattggagactcttgtgataaaatcagacaaaggaggaaacagaataacaacaacaaaaaccttatcacactaggtgaaaaggaggaaagaaaataaactggaaaattttgttaagcgtttccaaatgagagttcagtttactatatctcctgcatgatcaactgtttgaaaatatttaactgaatagatattggttaattggtattctagaattagtaaaaaagttgtgttttaattccttgatcgaatatgaattacaaggcagaaataaataatgaaaactgtacactaatataggaaactaaaacggaaaggaatgaagtcattccctaatctaacaatttaaaaacaaaagggattttatatacaaataatccctttaaggaaggtaaataaaaaagattacatctggtccaaatccaactaatagaacctaggaaaacagaatctgccaaatgccaattacagtatattctaattttctaaaacagtatccaacagatatatattgaactcaaaatattaaacattttgtaaagtgacatatcaagcttaagacaacagacaaatcatgtaaattttggcagcatgtaagaaaatagcttcatttgaaaaacaagaaaaatttcaaaccagaataatttttccatttgatgaagaacatatcgtcttctccatgttggtttccaagttccatctgaggattgacattaaagaggtatctcccaacacttccaaatctggcaaggacctgctcaaagtgagataacatccatcaaaacttataaaaaaaggagagtggggaatatagcaagtggaccatcacatctcaaaaagctagtatgatacagcaacacgacaacattctctagaataactactagaaattcaaagccaaaagtgcatgatttctattcccaaaaaataatccaaatcacctagatcctttagggtaaaaacagcattcagtttggagacaagggactgaatgagactggaattgcttctagttatgatgatgtcatccacatagactaggatgtaaacaacagaattttgctcagaatagaaaaaaagagaaggatcatacttgctggaggaaaatttaaattataggaactctcctcttgaaggactcaaagcctggatacacaagctctgggagcttgttttaagccataaatagctttttgcagctgatacacaagctgtttgttggaggatttaaagcctggaggctgagtcatatagacttcctcttgaagggttccattgagaaaagaattattcacatccagctcttgtagaggccacttataggtgagagaaagtgagagaattatcttgacagtgacaggtttaatgacgggaaaaagtttcattgtaatcatatcatagctgctggtggaagccattggcaacaagcctggctttgtatttatttactgtcccatcaggattttccttaatcctgaaaacccacttgcagccaatgtctttccttgaaggtggaaagtcaactaaggtccaagtgccatttctgagtaatgcatcatactcagccttcatagcagcaagccaagttggatttgaaagagcagatttggtagttttgggttcaaggtgggtgagaagtaatgttggattgattcttggtttaacaataccagatttagcacgagtacacactgagtgttcatagtcaggtttaacaagagaaggctgtaaaggaggttcagaatgaagagggggttctgaagttgcattgagtggtgtgggtgcactgagtggtgtgagtggttcaggttcagtagctggtattgattagttaggctcaatagtttgaaagaatggttcaggttcatttacttgtaagaatggtgaggtaagttgatttgatggtgatagaactatgtgtagtaacagtggtgggagtaggcaaaggctgttgtgaaggtgtgaggagagtaagggttgaggtaatgttaggtggttctgacgtaattaaagaggggctaggaaaaagagttttgtaaggaaaacaagactcataaaagtaacatctttggagatgtatatcctaccatcagctgcaaggcatttatagcctttgtgggaagtagagtagcccaaaaagatgcattcctgtgacctataatttaacttgtgcttgttgtaaggtctaagcagaggaaggcaagagcagtcaaacaccttaagaaaggtataatcatgtaatttctaaaacagcctttgatatgaaacctcattgtttatggaagaagagggaagccggttgataagatagacacttgaagtgaaggcatgatcccaataatgaagaggcatgttagcttgagagacgaaggttagaccaccaagttccactatatgtcgatgcttcctttccacaaccccattttggtgatgggtgtgggggcatattaatccgtgcaaaattcccaggtcattgagaaacttggtgaagggtctgaacccccaccccaatctgattggacagctttaattggaagattaaaccgagtttgaatcatagctttgaactgtttaaaaacctccaaagtttctgatttagttttaagtaagtatacccaagtaaacctaatatgagcatcaacaaaagtaatgtaatacttaaaacctgagggagaaggaatatgagcaggaccccacaaatcagtaaatataagtgcaaaaggttttgaatagactgatttagaggaagatgagggacgtctacgagacttaccaacacaacaatgattacaaaaatcagaaacatttttattgattggtggactattacaaagtttaaagacaattttcatagcatccacactaggatgacctagtctagaatgccaagtagaaaaggaacttgaagtataagcagctgtatttacaataggaacaacagatttacaagaatctgtatctacaataggaacgacagaatcacttctatcaacagaaacagaagcatttttacttacaaaaacagtattttaacagaagcaaaatcagcagtgctaagagactgagaagtccgaggcaccaaagactttaaggcgggaaattggtagagaccatcacgtcccactatcccttgaaaaagagtttcttcagtgtcttgtgatttaacaatacaaaaagaagaatgaaattcaaagaaagcatcattatctttacaaaattgactcacactaattggatttttagtaattgagggaataacagcaagattacttaggacaagagacaaattaggttttaaaggagagggaaatgtagagacacctgaggaattgacgttaagtccttgaccattaccaatagtaatctggtcaggaccctcaaaaagagttagctgctggatgttttgggacatattggtgacacggtaagatgcaccagaatcaggataccagctctgtgaaggagactgagcagtgctggtaagataagcctgagaagcagcatgagatgtggaactcgaaggcacacttgaaggcacaggattgggtgtatagggtaactgagtggatacagttaagggtaggcaaactgtggtggcaacatgtattgaggttggtgaaagtaagaaggagtccaaaacggggggcaccactaagctggtgcttgagtagtggtagatgcaacaggagaagccacagtcgaaaccgcagaggaagcagcagaagtagcagaagccgtggtactagaagcaataggaatagtagcaacatagttctcatcataccaatgataacagaaagatgcgtcatgcccccatttgtgacacacctggcattggacatcagcaaaatgatctcgaccaccaccgccgcgtccaaagctccgtttaatcaatacatgctcagtttatatagagcttaacaaacataacagaactaactgagtaactagctaactacagttgtactaacagaaaaataaacccatcagagtaggtatactctaatattttatgaatcaaaactgggacttttaatgttgggatgtggggtaatccaagtcccagtaaaaaataatataaaattaatgaacctccattataaactatttatttgaaggatactaagttaatttataaaggccattacaaaattcaatttttattcattaacaaaattcaaaatttccttttctttttgactggtggggttgtgttggctattttcatttaatgtggctccactcatgaactgaatagcattactgtgaccaaattacaagaaagcatattcatataagtataaccttaattcaatgtctccactttgatacagaagaaccaaaacacactctttctcgtctttcttgaaggttgtagtccagcagcatcgttgtacaaggttcacctttcgtatgtacttactgctaccctattattaggaaatttcattaccagtaggaaggaatggattgaaatttgaaggaagatggatgtgaagagcagcacctcaatcacaaaatttaaagagtgtaagctcaattcactctcgtaacaaagtaaaatgagtgagttcgatatcatctgcccaaaatatgaattctctatggtagtagcactttcaacttcaacttgtgcattttcagattggatgttagcttgcattctcgaatcactcttcagaggcgagttgggtgtcagtttttcagcagataggtcagacgtattaccatctgaaataacacagcaacataagtaataaaattgataacagattataatatttaattttctcatcgaaaatacttgccaataatgtgcattgaaattgcatttgattttacgctggggctcattgtcctactgcaaaccatattccctgtcatggtatctattgcaacaaagtgtgcatcccttgtcatcacatagactagccccactccaggagtgtcagaaatatcagatacagattccagtggtttgtttaacctactatctgaaaattttgcattcatagaaacaactaccgaagaagtgatagattcagtttttgtaacaaacaaaactgatgatgaactgatatcaagcatagccacctgtaaaatgaattagaaaaatataagctgcaaacttagtgctagtttaattcaaattgccactcaacaactcaaccaagtgaccaaaaacaaataaaccatttccttcaaaaaggaaaagaattaatgggtgatctcacctgcccatgttcatatccaacaacaagcttccctccaaagtttgcaaactgtaggctgcatacagcagaattttgaagggaaaacacagctttgcaatgaggtccatccccttgatgcgtattatgaactgtctcattagataaaaacaggttaaaatcctagattagaaaataaaaatatcaaatcattttttagcataaacagatacatgagaagtaacttaggtcattgacaattaaactgtttaacttccccttggcaattggggagcagataagcaaagtacccttttttattgataaggcttacaccatgagtatggcatttcaaatagaaaacaaaaaatacccaaccttcagttccattttctgtcactaagtgcaaagtggtgtcatctgaactccttattagcccatatagacgaacctacacattcccataggatacagttaccaggcattcaagactattgaataagaagagaatgataaatgctaaatactattaaatcttacaacaccactttcatcgccaacagcaagatgtagagtatcagggcaaaaacctaatgctgacactggcacacttgcattgccaattttaacatcattaacctgccaatagcaaaattattttttctttcatgatttaccaccagcatatgtctccaataaatgagtttcaataaatatacaaatgcaacaggggtgggggtgggtaaaaaatatcttttttaaagattgtatactctataatgaattatctaacctcatattctatgttgtaaagaattgacaaagcaggatatgtagcatcccatatccgaacagatccatcttggtaacctgctatgtatatttgaataataggatggtcttctttgaatggctgacctggaacaccaccagtcaaaggccactttataccaatacttttctgattttgtattgaacgatgctttgcagccacaagaatctacacattgtttgctattagtgttgagttgtgacaatcaaattttttatcgttataaataattaaaaatgttggtgctgcaaacttaacattatataacatttaacaccagggttaacagctagacatggaaaaagaaatttagacctaatacatgtgcagtaccttgaacagggccttaaatgacttcacatcttgacataccacatcaaggcttgctattgtcatgtgtggttcaagagtggggatgaggatgggatactgcacagtgggaacagaagccttcttttcttgctgagacattgtagaagacaaacaatcattgtcataaagatccagttgtccaggacttgtcaatacaaatagcatattacaagccccttctgtatggcaatcagtagataacaaagccacatcagcaaaagaaccatgaagtgtaacatctatgcagtcagtgcacttaagattttcaatcccaaaggaccaatcaatgctcagaacctgtaaacatgaaaggggcacatcatagtgacacattaattatctacataaataaattttcaaatctaatgtagcaaaagtgaaatactaattgtagcaacaatcagtttcaacaaaatagtaattattaaatgaccctctccccgtaccttgatttccttggcatagcaaggaacctctaggcacttggatacataattttttttaacaaaggaattaaaaacagaaacattctcgaagtgagcatagatcattgacaatgtttcttctaacctattcaacctttgggataaaatcataaaactcttgcttctcctaccaagaggccacctcacacaatctccacccttaaccctttaaacacaagagttttgcctccagctcacttcttctttcaactaaacattcacaagactacctgttaaggtaaggatcttgtgacaacttgaacttgtggcactcattattatggcttttttttctgttattatattcaaacactacaatcataaccaaaacaaaggaaattttttcttatctaagcataatctcttgcaaatataaacattatgatagatgacatgatgttttcaattattacaataactattaaaacgccaatgtcaaatagctagtatgcgtatgaagcttactgttagaacttcttcagatccaatctcatgaccaccatagacaaaaagtttccccccactactattggcacaccaatgtaaaacaataatagggagtcttctatcagctgatgataattgaagcttgacaacattattcgacaatcttttaacttgttggtcaaggggaaagtcggcagttgacaaatcccaaaacattatatcaccatctacataacccacaacaacaactgatccatcattagatgcccaagatacagagcttatatccttatcctcctcttcatggtctaatttatcatcagaaagctgaaccctagagtcatttggatcactagccactatttttctcttcaatttgatgtccttgtggcctctaacgagaacaattcgatcttcagaagcatcccagagtaccagcaaaccattttcatatgcaattagcagtctgcaaaatgacaatttcaagtaaatcaactaataccaaatttaaattcccttaagctttatgaaaacgtatgtacatgtgtataacagtgtatcttatatatgtgtgcatgactgttaaacacgtagatttattttgtgatgatgttttcaaccgactacaatcacttagcattgaaattgaaacaagaagtaacgccatgttgaattatatctggattgagtttattctccatgttgtatatttcaaacaagaagaaactcctagcaattaaaattgcattcgaataggataagtataatccattgccacacaacaatagtgaataaaactttactttacccccaaaacatggctaaagtattgcatatactttgttcaaacttcactatataagaacatttgatcctatggttataaatcaactgggttctgtggtcaaacctatctagatatttatgaaactctaacttactccgactcataatttagaaaatgcccaaatatatgactatttaatagaaaaatcaactagcctagatagagatgcaaaatttcctataactcatgtcacacatctttcatagaacataaggaaattaatcagagaaacttttaggtatgctcctgtcctgcctgattccatcagaacaaggttgatggagaactctgacaactgaaacatgatcaagtgacatcccaactgcttctgcataggtgagcaacattttgtaacatgttagataatagacttagagaaactgtatgattacccacgtgaaaaaaggcaatctaaattagatattaacaacatgcttatggctaggaagtaggaacttatgttacatttatgacataccaacaataatctgctccaataaggaaatttcattgaagctgatcacaaggcttcataagttgattaataaagatctatagcaatttataaaccatcaatgtggggcaatatatgaaaacaattacacaagaaatcgcccatgaaggacaacaccattaacctaaaactccaaagaattctttacctaatagttaaagctttttcactttatggtcaagtgattccttaacctagtataaaagcctctttgataaataaaaaattaaaaaaatcaacataaggtagctgtggatctgtgctttaatgacagctcaagcctaaatgaattttgcattaagggatatattaaagataaaaataaataaattcttatgtcatcccctaacagcttaaactttcaagtcaagtgggtgtagaacatctatatacatgtaaacatgcatggatattagcaaaatgccaaaatagaatattagatcctgtataatagcatatgcatttatacaaaatctcatgattagttataaacttaacaaccctgaactcaaaatctctctgggtgacacacatcacccatgtcaagaaagttgatagactacaccaaacatgcaataacaacatttctcgtgtacacaaccacaaggtcatctcaaaatttgtgattaatgggttccaatctgcatccagactccagagaaagttacccaatatcttaatcagaaatttggaacataaaatttctctcaccacacaccaaaattcaaaccaaagaaaaggtcaatgcttcttttaagccagcaacattggcaggtacaaaaatactagtcttgcttccaacctaaatatggtataaatgaactacaagaatgagtgcataccagatataacatttgtgggaacataatagggtaatattgtaatttttctgtcttcagaatcgaacatcaacacatatatcatcccatgctcagttccaatatacctgaatctcattaagagggcaaaaatgtaaaatacccatttaccaatattttcttagaacaagtagcatgcaaatgcagataaaaaatcatctgcacaagtattttacatgtaattggtgccataaataacagagaaagcagttatgatagattcccactgcaaggcagaagcaatttgtttgcttttcaaatcccaaacctgccattatcagaaacatactgagctgactagtgaatgaaactgaggaaaggggagaatgagagtaaggggaaaaaaaaactaggcacaaatgttaaccattttaaaataacaaaagcatccaaggaaagaaagttcatatggaatacccaaaaaacagggtaaaatatgtttttgggccctcaaaatatctcgaactttggttttagtccccataaaattttaatacatttttaatctctaaatttaccaaagtgatacagttttagtccctcatcaagaatacaaacatgtgtttctgttaaaatctaaggactaaaaatgtattaaatttttaaggcactaaaactgaatttcgaaatattttgagataccaaaaacatattttaccgcaaaaaattattactcatattcagagggtgcctggtcataaacagtttaaaagatctcatttggaagacccaaaaagaattataagctaatatgtaaggtacctgtatttcgttatcacttgagacgctggcaagaaaaccttgattttccaagaactgtgagaaatttgcaaaaagataagatataatattattcatgaaatccctcaaaatcatttcatgtctagagtttaataaatgtacaatgttagatcaataaacatgcaaatgcacatcatacacacactgacacacatcagtgcatcaccagtcaccacatacgcatattcaaagaaaaaataaaacaaaatatcgaggtaataaccaatataagattaaatgactgatgcacattactctttagtttcaagtttcaacatgaatccaaaattacgaacctctaaatttttgaagtatgcttgcttgggagagataagaatcccttcaatattgtcgccaccaaacacctttatccttccatcactacaggagggaagaaaatgccagagtcagctcaaaaactgtctagctctcaataccataaaggagtaatagtaactagtaataactaatgtactacatctaagctacatctaagctactcctcaatcatcacaacaaaggaataatgaaacagagattttattttatttttcaagtaaaactgttaaaaatacaatttcaaaagcacataataaaacataaaaatttcctttaataacattaaaaaaaaaaagtgcataacgtattataagctagttccaatagcatgaatctctatatactgcatagacagttttctaactaatgaaatttcatttcggtatcattagaaatcgagaattccaataaagcagaaaacatgaacagaacgtgttgttccaaagcaaagcaaataactcacagtgttcccactgctaatagacgttgaatgtgatcaaaagcgagaatagacgcagtagatggaacgccatggtgaagaacaactcgcggatcgaaattcggcgaaggaaaactatcttgcaccacgtcatgctgctgaacgacgcgaaaaatgttcagaaacaacgtcaatttcaggatttgcattcatatataaactcgtacgaatgcactattactattcaacaaaaaaacaaaaggtttccaaacattctgcaccagcattcgtaacagccagaaaaaaaaaaaatcgaagatgctagaatctgcaatgagcgtgaacagcgtttgtttatgtacctgagggcgttgttgcggtggagatttgtgaaagaatcgagagaacattgttgacgatgatccaatccaagagcttcttcttctggcttttgtttgtttgcttcctctgctggccaaatttgtattccgattttatgtttcttcgtgcagtgctgcttcatcttcaggtgccgtgggaatcaccagtatggtacatcgtgcacgtctgctccttccgattttttccccatcgaaatggacggtgatgcgaagcctgaagggtcacgtggacagtccgatttcaatcttcaaaggagattttgggatatgatctggagcaccaagtattaccagcacacgaaactcgaaagttaacacgggcccatagaaggcacgcactttgcttctctctccacctccctcctcttgaaaataaaataaaaacttaaatacctatttggttttttatattatttaaactgcatcaatttaatctccaacttagcgctgttagcaataaaatgactataatggaatcaattgaagtattttaaataatttcgggatttaattaatgcattaaaataatttgagatctaattggagctttaaaaatttggagactaaattgatgttttttaaaatgttagatatacatttttaatatgcaatttcattggttaataaattgataattaatcctaaaataagatttgtctttacttttttaaaatgttagatatacatctttaatataatttttttatacaattaattaactagaatttattcttgatataatttttaaaataattattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagttttttttggtcagttaagtattcacatcctcttgaaaatataaattaaatagaaattttatgatacttaaagtgattaaataaaaaactagaatatttagcaataatacataaaaaaaaaactaacaaataattttataaggaaaatttaaaaaactgtactgtaacgttttgaaaatgggacattgtggaaaattcttcatgtttaaaaaataacaaaatacaatttacaacaacgtatagggtgtttttctacctaaaaaagtattgataaagcactttgaccggtagtttttcttcttcgtctgattgataattttaattctaaatttttaagttttttataataaaaaaaaaaacatctctaatcagttggttttcttacatttttaattactagtttctaccatcaagcatgggcggatccatcttggagagaaagaggtaagtatcctcccttaaattttaggatgaaattaacacaatatacatttttttcaaaaattaacatatgacatatctatgggcggatctaatttattagttgggggacagtgatccccttaaattttgccattaaaattttaatatatcattagtacttgtttgcagtgcttaattatttttagtgtttgttatatagtttgcagtgcttgttaattatttttatttttaagtcatgcattagcacttgtttataagataattaaagtctttgctcttaattgaaatgagaagtacaatttaatcatatccatttagtctatattgtaacagttcatattcaaatatctcaaactcaatacttatatttaaactaactctcgtgttgtcatcatggtcttttgaaatctcatcgcaagttataataaacttcttttattgttctattcaatctagaatagtaatttagtctgtctgactatttgtttgttcctttagattataatttataattatttgttcatttaaaaaaaattacaaaaaaaatttcgagggcgctgccccggaaccctgccactaaatatgcggacataaataaatttttctgaatctactactaatatcccttaattatttttctggatccgtcactgccatcaaatatatagattaactaatacgaattgttctaactttatcatatagcttagattcaaatcttgattttatatttgaaggaaaaaaaattattgtccactataatctcacacgggaacatatttagaggggatgaacaagggcttagactccttccctttctttgaaattttttatgtatacacataaatttttaagttaattaatataaaattaattttgtatgttttattataataatgattaagattagttagtgaaaatctgtgtaaatttagttgtatttgttatttaattataatgactaaagtgataactagtgtaaaattgtgtaaaactagttatttatttattgttattatgataataattaaggttattatcatttaatataaaaattaattttaattttatgtgtaaaaatagaatttttcttaaaaaatattatttattgaaaattagatatttaaacaattataaagaaagaaagaaaaaattcagccccattttataagatatctagatctgtctcttccgcatatagttaatcagacttaaaaaataaaaagtctgaattataataacccaaaaataattatattttggtttgttttcgacctcatagttcattaattatgttgggtgagttgcaggctgtgagcaatccagacagtttaaaccgaaatgaacaaaaaacaagtaaaagtttaaggggtgtttaaatcgttataattattaatttttattaaatcctaaactagaagtgaggaaattaattttgaaacattaagaaaacaaagagtttaattaaaaatgaaatagaaaggtaaataaacaaacagttatatattgcctttgtccaattgtccaattcaactaccacctttgtccatggcctgcttgctgccacgagagacgcatctttcctcataaaagggcacagggctgccactaactatcagccctaaacttgcatggcttcaaaagctaccatttttcttgcaaccacaaacacattgtttaattatgcaaaatctgccacacataaaataatgaacatgctgggttagactcattgtttcaatcaatatattccccattgtacttgaataattaagtcctgactattcccactgttccttgtctcgagcctctttagtttaagaacactgactgctagacaccataccaaacatattactttgataagattatacaattatattttaatatataaggtaaggttaattagtaataaaataataagaattatgcaatagtgggaagttgtttatattttagatggtatactatatattgaaataatttggtaaaataaagtatatcagttatttttaatttatttaagatttttctaaatttaatttattttgtaaaaaattaatatcatagttagatcaataaaatttaatatttataaaattataagaaaaattatatattttactcaatttaatatttgatattgatttttctatctataaaaaaatatttgatgttgattgattttgtcattatgaatattatagtcatcgttttaaatatatatctattgtttgtattttattataactatcctgcatctcctgtgcatttatatgataattatttagaaaaataatttccccctaataaatacagttaaattataagataaaataataatgaaataataattaattatatattaagtaggttagtaatttatataattttgaaaaataatattataaacaatctaaattcagagttgttggtcataattaaaaaatcaaaataaaatctttataaaataatagttttaattatgtatttttaaattaaaacttaaattcatatgacgcgtatcattcataacatatatgttgatttctgaaaaatgatataaaatattttaaaattttgaattatgaattataaactaaaattattattttatgctatatatatcaataatatataaaaaatataacaaatttgaaggacaccaaataatgttattattcataattgacaaagatatttattcaaatagcttaaatataattttggtcctcatatttttctcaatccatattttttattcttccattttaaaatagagacatttgatctatctattttaaaaaaattcattattttttagttatttatttcaaaataaagatatttgatattctcatttcagaaaaattacattttagtcaaatcctcaatttttcaatgctttatttcttttattttgatatagtttaaccttaatttaacctgacatattcattttaaatatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttattatagacgatgaattattctttaatttgtagagagagatgtttttttgtatgttcatgttaatgattagaagctctaaaaatatcaatcaatgactactatttactagaatatagagatttcataatcaaagtgaaatagtatgcctttaagaactatcaaaatagatcttccattttaagtaatgaaatcaaataaaaatttgttgtaatttagcattaattagagaacccctcagtcaattataacaatcgttgaaaaaatgggaaaaaacgagtgctccaaattatgatttaacgaaaatgattcttaatctccacacttcattttcttatttaagttagtaatgaattaatcacataaaatttggatatgttggtcacaatctagctagtatttagaggaacctctcaaccattttcaataattatttaaagacaaaaacagatcaatttctggcgatcgagatttcttcaaaatttaatgcaactataacaaaaagattatcgtgatatagaaacagaagttacgtgactaagttttttttagatgatggttacgtgattaagttgaattaatagaaaattaaaggtcaaaatcaaaacgaacctagaaattaatgttatgtcgatgccatatgttgaacaagcatagtgtcatgacatacgcaatctcaaacaaatatattgtaattaataaattttagtcacatacgtgtattaatcaaatataaaagatttataattaaacataaaaagttataattataattaaaaagaaacttatttaaacaatttgatgaaatgaaagcgtttgactaatgtggccaacaaaatcccaaggttgagtgattgaataacacatgttacaacaaaatcccaggttacattcaacttttttaaacaattgattaaatgaaagtgttactaaacaagatcttacccacatcagcaatcaaatgtggcatataaaaaaataaaaaagtatcatataaataaaataaaataaaaagttaaataaaagtacataactaaatttaaatagaattggtaaaaataaaaatattggatgggaagattaagatatgactgtttatttaagaaaatttaaattttaagaattaattattttccttaagctatttgaatatgtaagttaagaaagtaattattttttaaaataaattaaagtaaaaatggaataattgtcaatatggaagagatatactagtaatataattaattatgctaaattaaaatctgcaaaaatgaaaatttcattttatgatcttgccaaatgcgttaaaaaatatcccaatgttgtatagtattttttttttttttttttatagtttcccaatattgtctatattgcctgccaactccgacattgttaactagattgtctcattttgatcaatcattatatcaatgaaaaaaccatatcagacgtcctgaaaaaatggaaatggaaacgggcccatcacacgtgtgaatcgtcctttgttccgcatatttcgcacgctcggacattcaccacaacaacgagcccaacatataagaagacccacagggtcccaatatttcacactatttcttattaacatattattattctctcacgtaatggcgtcttcaactcaagtgccaaacctcttcggcagcgccacctcagctccgccgccaaccccggcggcgcaccacgacaacatcatgtcctcctccgacgccgccgacgcgctctccagcctcctccaccgcctcccgcccacactctcccttcccacgcgcctcccctcgccttcctccgcagccgccacgtgtcccccctccctctccctaaacgacgtattctcctgcgtttcaaaactcggttacgcgcaactcactgatcactcagtcccctccgaactcgccaactcggccgagtcggaggcgctcgcgctctttgacctttcccaagaacagaaggactctctcttccccaaaaactggcctctcggatacggcggcgacgacgaagatgagctcgccgagtcgttccgcttcgactcggcgtgttcgaccgagtcgaacgagttggcactctcttccctgcgcaagtttgcgcgtgaactggagaagctgggtttaaagatcgttgatgggttaacaaaggacttggggtctgggaattcgcttggggatgacccgacccggttatgttcggttctgtgggtttcggagtctctgcccgggaataaatcgggtggattttacccgtttgtaatcgggttgcagtaccagataaggaatcagaaatactcattgctgtcggattcgggatgggtttctgtgctgccacacgtggactcgattttggtcactgttggtgacattgctcaggtaaattattattttaattaattaatgtttttgttcagacataatgactgtgacttcttaattactgtaactgtttgctttatgtttttggatatttgttatttttgttctctgatttattttatatttatatttatatattgatagtataaaataaatctcataatgaccgttctagggtctcatcaggaaggatattaccgtaccgattgtattttatctaggtgcgtattggccaaatcatactgtttggatcaagatttgacccacaggatacatagtttcctagcttaaagcaccacttgtgtagggattaagtgcgtagatcgacataaatccaactcttaagatatataaattgtcattcaattactaatcatcttttaaatgactttaaaataattatttttaaaaattaataatttgtgattcaacagctgtgtaaaactttttacactttaatacataaccatttttctcaaaaaaatttctcctagttatggtttgggggaaaatcggaaaagcttgtgtataagcttgttagtttgttaggtaatcatggtggctagtataaaattatatatttatgatttgtaatcactctattgtcccttaggtacatccatagtttaattttgacacctgtatgtataaattgaagtttgaacaaggtttgaagacacaaactgaactaatcacgttttatttgaactatgtgatttcacctaatgagacaggcattcaggcaatattagttatatgaatgagtctattttggttgttatacttctttacactttattaatttatttctgcatgtaaacattgttagttttagtacaaaaaaatttaatatgttttgttactaatgtgtatagccatactaacgtggttgacagtgtagctgttatgatcgctacaaaatttatggaagattacaatatttatcacggtttaccaattgttagaaaaattctatcgtggaaagaattttagacggcttaacaattgctagatttttttgggattttatatagttataaattttttgcatggatgttgcaatggctaaagttaactttagctaagttaaaaaaataactaacattagaaaccaaattacattgtatttactttttcaaagactaaaattttcaatttttacataaaggtcaaaacagtaaagtgcaaacaaattaataattaagcccttcttttttagtatggagtcttcttttagttgttgggtcacacgacaaacgagagaaatgttgctttagtgatttcattctacattattttatagttttaataagagtttaaagtgaatgtattaacagtttcttattaattatcatttaaattattttaaaagtaaataaatttctcatagaattataattaaataattatgtcaaaaaaattatgtatcaatatatatttgtttttctcttttaagaatgataatgaagttataattaaaatattttattacgtatgtgtaaagtaaaataatcattgttcttttcggtcaaacattttggcacgcaaattctgatttgatcctgcagataatttatgttagttgggcccccttctttagcaaggtgggtaactatgcagaatgcactgtttagcaatgtccctatgtcggggtgtgtctgttcttcatttttcattgggtgtggcctaaagtagaaaaatctccaattcagctaagaaaaagtggactaggcaaaagcctcaaatctcaaatgttataccacacatcgtttcctaagaatagaagatgaattcaatttcatatggaggaaaaaaatcatatacaatgccccataagtgtttttgtgagtgtggtgccttagtttcttagtagttggtttcatatttcttgaaaagtttaaaagattcattatttgtacaattttgtatcgtaccatcatgtatcttttttataaattattttattttgaagagcacattacattaatcctaggggtgatgcattgataaagtgggctactatatgaatttaaacaattactgtgtaggtgtggagcaatgacaagttaaagaaagtgagaggcagaccaatggccacagtgggagatgaaaatggttcacgctgcataacaatgtcattgttgataactcttcctacagatagcagagtggctccactccttcccaaggcaatctgcaacaaggaccaaaaggaagaagaagttgaagaagaaagcaatggtggtggtcaaaaactagagaagagggtgttcaactcttttgattttgaggactatgcttggagagtgtaccatgaacgcatccttttcaaagatccattggataggtaccgtgttgcttagaagttgttgtttaattgatcttctcagccattgttttgtgtgagattcattaatttgtcatgctagtgttagttagtctagtaagatttgaattttggatgggtgaaagggaaatatgagaggactacaataaggagatgtatatcatatgctccatttatttattggattgattttgaagttagagaagtgtcacttattttttactttagctttcaatcaagaattcagagtttgtgtcagttactctagggattggggtccaactctgtcatgccgatattgacggaacagtggcttcaattatatatctttcaatgaagtatcattaaatattgaatatcctgatagaatatctatctatgtatgtttttatgaaagatgaaaaaaattgggttttattaattagttttaaaaagtaacgataaaagaacatcaaatatacttcataaatacttttatttacttttaaaagcatatactaatattttttttatatttgaaataaaataaatatttttcaataaaagattcttattctagttcaaatttcgtacattatcattgcaaagatttttatattgttaattacttaaaaataaatttaaatatcattttttaaaaataattattataaaaaaaaaacaaattcagtatgtaggccaggtaatctatgataggatttttttttttatggggaataactcattatttcaataacgacttgctcctcagtacaagatgataaaatatcaaagaaacaagaatcatcatgagatatagaagtcgtctgttaaaaactatgagcaactaaatttacttgtcacgaaataaagtacactctagcatgaggtagtgcttgtaacaactgcgtaacaatgacaccaaattcagaaatgtcttgcctacaactatataggttgttgacaacacgctgattatcaagctcgatcacaatgtcaagattttgaagccataaaattgcttccttctcttcatggacctgcggaataaaaggtttccaatcagagaatgcggtttcaaattgaatttggtcatatcttatacaggctcccaagccccatcacaaaactgctacaattttttacactattagtgtatttaaattaaattcaaataattttttgttcattcaactaatatgcttaaaacattagttaatgtttgttaatataattttatagaacaatgctggataatcgtataatgaaatgtcgaagttcaggtaactactgattgaaaattctaacttacgtatgggtgggtagtcatgggatgtatctttacccaatagagttatttatttatatctaaacttaaaatccatttgattaagatctaatgatatatagaatataatcaagtcaatctgatttattgatataatatatcaaccttaatattatatatagttaaattgtagaattaaagaagtatatatttacaattaatgtatattttacaatatattttaaaataaataatattaaatatagtataatatcatgtcaaacaaaatattgtttattaaactaagaagttatattattaatacataattgataaaaaagatttatacgtttttaaaagaatctaagatatcgaactaggtttgaacaatctgaagtataacttgtatccatccttaaaatatactgattttaatttcttaaaagtaatttcaagtcagatcaaattaatggaatggtatggatcataaacattcctgattctttgggttaaggtacacaccaaggttatttaccatcattattgaggagaatgtgtattaaaacttgctacgatcttgtaatcgttttcatctaaaacagctttcagactccaactaccacttctaccattctccctgtcttcagattcactactagacgtcctttactcaagtgcctttgatgacatacttttttaagcaaaaatgtttgatggatatccattagcctatcccacacctggaaagagagataaaaaaaaaagagaaagagatagaaaaaataagaaatataatgaggtgtttaaattaaaatatatttatgtattattacttaatttttttaagaattgctagttgctactatattctacttggagttttcttttgctcacgatttaccagtccaaaacaaaaccaaggtccactcaggcagggtggggataaacttttaataaaaaacgaacaaacgaaaatgtggaaaaacaaaaaagcccattcttatgtgcaatgtgtttggatttgaaggtactaaaccagagaactaattgcccaaaaataaaatggcaaaagaaggggttcttaggaatggacttctctcaggtagagtcgcaccttagagaataaactaatttgtaataataaattatttcaattaacaaactttcattaaaattatcatatcagatttttatttaaaaaaataaaaagatattgaactaaaatagaaaacaaaatatgcctgcctacatcgcctactcatttgacatttccatggttttgcagaaaaacaatcctcatgcaatagccacgatttacttatatgtaattaactttccttgccattcatactaaaatattatttacttttagtagcaattatatagtagcaataaattaatgtctagtagtactacaactttgcgacaaataaatattagtctacaaaatgttaattcataggaaaatatatttttttggacagaattcatagtaataaaagctaataaaatggagactttgaaattcaaatacaacgttatcaacactatgttattacatattttccttaacatttttttctatataaaaaaataggagactttctttctcctgtacttccaaaagaaaaaattgtaaaacattgaaattaaaaaaattatcgattgttgttttgnnnnnnnnnnttagcatgagacataagttggcgttggaccactttgatttttttatattattattagtgctcttttccctcatatacctttatttatttccccatgttagttacgattaggtgatcatcttcaacatatttatctaaggggtcgttaatatttttaggatcgacaagtttggctttaacagtgatcgatgttgccgtttagctaatatgatgtatacatctgaaagttaatcagatgttttggctttgatgctttcggaagtttgtctttctaacgatctgcttataatttatatatgtttcccttcaatgcaaagcttgccaataagttaactagcacacacatgcacctattgatagggggaaaaagaaaactcgagtctctgattaattcttacaatagaatgactgaaaaataggagaattagatgtgagaatgagtagcaaattatatacttattagttatatatattcttcctgtaaaggttgcattggaatccaccccttgagcattcttttggattatcaaacaaattaccatgatcaaattaaccatcaagactataccagacagacgttaaaacatatgtcttgtttggtggtaatatttaaacataagttattatgttttaatttgttgtatatgaagatgcgataaaataaacttatcctacatgttatttagtagtataaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccccatttttaaccttattgaagaagtgagttatgagctgatcgacttcctaacaaaattatatattaaatctttagcgagtttaaggagttcaagacaatcatttgtcgtaacattttataaatgaaaaatttaggtatagtatttaagagatttcatttatcatgagaaaatccataggtgttagttcagttgaaatagttttatggttttgagtattgaattgtccaagatatcaaattttcaaagcttgaattagtcattcatgacaaattttgactaaataacttatgcttgcacagttataatggaagttaacaaaagatcgattaaatttgacacgaaattgaaacttagaagaacaaattgatcttaaaaaatactcatatattttacctctcagatccctagattcattaaatgtcaaagggtgcaactatccacgatgtttcttgcatgagcaaatccgaggcaacgatcgtgtcaatgttgaataaattatcataagattgctggaggcttaattaagccgatcgaggttagtaatagaaagtccgtaaatctgatggctctagattttccttccgaaaatatctggtaaatctaagaatattcagtacattctattatactttttaatcatttaaaaataattctaaaagaatttctatattttaaacatagtaaatacttcttttattaaagttcctgcatttaattttgtctttcagccggtgttcttagactgatgtattcattaagattagtttgtctgcatataattaatttaagaataaattatgcatgctaaatgtgtgtctattaattaaactcttaatctaatactagtattttttatccaatgaggttaatatagtataaaatctcatatgaaagaataatttatttaataaaataatttatatttgacagtaaaattttattgattagttataatcactaatcactcattgatgtaaacgaaattaatatgtgttccaataaattatggataccagtgatctatggaatccatgaccaaaatactagtatgtttttttttttcttctcttttttggtcgttttaaattagttgacttattaacttgttgaatctacactctaccgttggagggtggttctcaaactcaacacaactctctcaccatcaattaaagttgccttgcaatctcaagagtgaaaactgaaagacagcaacattgtgtccaccaaagagcctcacaaaaccaccaccaccccttcacctgactgagactgctaccaactttgtttgaaggctttgagatcacgtattgtcccagacacaagaattaagaagatgttgaaagtggttactaatgcctcacaaaggaaccaaaatcacaacaaataaaataaaataaaaatagatcaatagatagatagttccctagcttgagaattgagaaatacaactttcccttcaccaataacctcttgaaagacaagaccatttcaccaaaccttaattaaacgaacaaacccaacctaatactactacttgaattaatttcaatgtctctcgttgctatgatccctatatttctacctctctttgcttcttcttttctcagagattattattgttattattctgatatcatttcctctttcttcttcttcttcttttcccccccatgcagcctcttcgaagaaaaactcctctattcaccacctcagaaatgggggcaatgaagggtcgcaagaacaacaacctctccatcttcgtggtggtgttctccatcttcctctttgggctcttcatgtacaacgaggatgttaagtccattgccgagttcccattctcgagtcccaaagcgcatgaaacacaagaaggaggagaacctagtaaacatgttgattctgttcaagaagacagtgttgttgttgttcaaagggagagtgagaagaaggacgtggaagacagtgtcacagtgaaagtttctaagagtacttcaagggctcagctagagaagagtggtgctgaggatgaggattctgatgagcgtgttgatttgaaaactgttgtggagaaagagaagaagattgaaatgccacgtgcggaggaagaggaagaggtggaagaagaagaagaagaagaagaagaggaaaaagaagatgagaaagttgagttgccaccagaagattgtgacttgttcactggggagtgggttttggataacgtgacacaccctttgtacaaggaagacaagtgtgagtttctcacttcgcaagtgacatgcatgaagaatggacgacctgattctttgtatcagaattggaagtggaagccaagagattgttctctgccaaagtatgaatttttgttcttttatttccttttttttctctatcttcttagtttgtgttttttttagtagatttgtttcttattggttgtgtttttgtgatcttgttaaggttcaaaccgaagcttttgtttcagaagattagagggaagaggcttatgtttgttggagattcactgaataggaaccagtgggaatcaatggtttgtatggtgaattctgcggttccttcatcatataacaagacctggtacaagactggttctcttgccatcttcaaaatcgaggtttgtaatttactttctcctttttctcttgttcaagcaggggtatatatgcctgaaaacaattacatggtttaggactaccgtgtcagttttaatcaatttttatgttacattgaatttttcaatttacaaaaataattaataaaattcaattacatgttaactgaatgaagaatgattcaaattatagtagtttgaacttggtaataatttctcatatataccggtttatttgaaccaatccgaaatcataataatgaatttgccataatgattaagcacaagctataatagattggtaaagtactgttttatcttaattattttttatctttttgggctagagtaagtgtaaaactgaaactaaagttaaggtttaattcagttggttaactggatgtgtgatttattataatttttttaatattattgtcgattcctacctataaaaaaaaaaatattttaagtatgatggtagtgggccactgaatttgatgaccaaatatgggttttttaaataccaagttacctacttgtttggcctttgtctgaaagttctggctttggaagattgtgccaatctcttggtagttaagaaaggacacgctgcgtagggagtattcaattactaatattgcttaggatacactcctgttaagtactagctggtcatgtttgtgtaggagccagagcacgttaccaccgtggaattctattgggcacctttccttgtggagtcaaattcagatgatccaaacatgcacagcatattgaaccgtataataatgcctgaatcaatagaaaagcatggaatgaattggaaggatgtggactacttgatctttaacacctacatatggtggatgaacactttctctatgaaagtcttgtaagcacatgattaactctatcccattaatttctttcctttcttgaagatttcgtgattttcaagcaaattcatgagtttgtgtaattcttgggtgtgatgcaatagacgagggtcatttgatgaaggttccacggagtacgatgaagttcctcgcccaatagcatatgggagagtcctcaagacatggtcaaaatgggtagatgacaacattgactcaaatcgaactaaagttttcttcagcagcacatcccctcttcatatcaagtaattaattaatgactactacatcttaatttatgtcttttcatttttgaataatcaacaaacattgatttcataatacgaatagtgatatagacacaatgtatcatataaataaacacattcagatataataaaatttaagtctttctgtctttaagtgttgcgtcatatccaatataaaatttttaagtatctttaatgatacagattaattgtttttaaaaaatgttcatatacgacaaaaataaaaattgtatctaattaatctcatttgttacacactatttttttcctttaacatcattttttactagtgaatgaggtgaaaatgatcaatcaacatcacataaatacatattattcaccaataatttagttttaaaatgtttgggttcatatttggtaacttgaaatatccttttgttattttaaaaaacttatctactaattcattccatggttagttgacaccaaatagtttaacccccttgcaatcctccataaacaaatcaatgtgaaaatacaacatatttgctatgccattaagtgggaccatatctggcataaactacttaacagcatgcttggagttttcactttctagttggtgaccctttaccacattttttttcttttttacaaagtttatagttaccaacttaccatgtgtacctaacaaactaagaatacttttgaacacactttgaattcaacattaacatttaaccatatgattttgtaggagtgaggattggaataacccagatggtataaaatgtgctaaggaaatcattccgattctcaacatatcaaccccattggatgtgggaacagatcgtcgcctttttgcaattgctaacaatgtgactcgatcaatgaaggtgccagtgtatttcattaacatcacttctttgtcagagttgagaaaagatgcacacacttctgtctacaccatacgccaaggcaaaatgctaactccagaacaacaagctgatcctactacttatgccgattgcattcattggtgtttaccgggattacctgatacttggaatgagttcctctatacacaaatcatctctcaatcttgacctacaacaaacaacctatagatatcttcacacacacttctattcctttttccctctttccttaattgttattatttctccttttacttatgaaaaatgctcctttttccattgaatgcttcaagcatttgtttcagtttttgtaatttttagtcactttttattgacttttttttttctttttaggaattgggcattttttcccctttttttcctcatgtttctttgttaagccaaattagcaagtacggaagctcagcaagatccttaaatgtacaatgaatcctttctccttgaatgaagaaaaaataaagaacgaaggttttgtttatagtttctaaatagttgcatattatgatcgtacgtctgtacacgtggaaagtaagataacttcgattataaatattgcgtgtaatttagaccaaataaaaaccttcctaataacttgattatttttggataatagtaaatagaaacaactctgctaaagaatccaattaaaaccaagaaatataagcttgtctatcatccacaccagaataaatgaaatcatatttacaaccctttagtttataagtttttaacaaaataattctagaattacataaaaaaaaattatttagaaattttgtgtaagagttgctattaaaaaataaaggtaattctacaattcttgaaattttaacaagcacctatgaattaatattagtatatcactggctattgaatgacttgtataagtttggatgcaaaattcaatagttgaaaatgcaatgataccaaaattgatatataagaaacatgaaaaagacgacttgtttgtaccagatatagataccactagtgttcatcagattcatcacgacttgcttgtactcgctcaaagcagttccatggacgcatgcatggctatacaaactagtaaacaagagttcagctgtatatacacatgcgtactcggtttccagggacatactctcaaatctcaatgtcaatttggtttgtggaacaggaaagtatgcaaagggataaacttgtatgagcaaaaatgctttcgcagctacagagatgtgaagactgctatacattagtatttgcaaaatcaaaagattacagctgatatacaatcataacaaacatctatctatctcgctgatcacatgaatgtgagttcttggaaaaaacagacgcaagatgggaactgaagatgacgacataagcttaggtttgactctatcaacagctgtcctaattgcagatgaagatggtacatcaaaccactgaaggaaccaagaaagaagtattgaacgtttatcttggaattctccatcaggccattttcccaatttcaaatagttatgaaaatcatccttcaattcctgggaacaatttaggagctcctctacctgcttccgtagtgaaccgacaaatgttgattgcacaattcctccttttggagaagataattttccagtcatcaatgcctcaatatatgtcagtgcaagctgcaagcagatacaattagcatcaagtcacacatactcataaggggtgggctagtgacctagtgaatgagactcgtaaaattcgggttcgcgggtggcccgtaccgtgaatacccctaataacctatttcttgatcataaaatccaagagaccaatcgcaaaagcccagtagtatcaaatcagagagaaagcttattacttgagaaagcttagcataaaaccagtttagagaaagctaatacttgaaaagaaagtacaattatcaagactaagcataaaactaccttaaaaccagatatagagagtgagtcaccaaaaacaatggcaccgttagtaacttgttcagccatcgattcaacagttgtgtataatgataaatatacctgcataatagagccatcaattaaataatatcagaatccaataataaaaaatgcaaactctcattatctaatggtttacagcaaacatagacattagaccaaattttatttatttacacaaatacttataaagaatcaagcgtctcagaagaaacaattcatgtcaaatttttatatcatgtagatcatgctcataaaattccatggcatttcataatttatactgtaataactaatagtaatttagtacgagattaccgtcgtggaatctaaaacaggagagattattgactgcttgaatatttacttacggataagcaatttgtttgaaatgccacatgtatgatcaacatggaaacacagccagtatttaagtttttagattgggtcatcattgtttattgaatttagggaatacaaattaaccttctaagcacattacctgtaacagagctggtctatccttggtcacacactcaaataatacttgcaagcagaattccttgaaatcaacatcagatctgcaagcatttttattagtttatttagatattgaaccgtctttacaacaaaaggaatgtaatactatcttcaagaagtctgcataattagttatacttgaatcatctttgacttatcatctatgatcttctataaaaatcttgggaataacaaaatgtaaatgtaaatggtttaagaacccaaaagagaaaaggaaaagaaaacctttctgaaggaaagccctcaatcaggcatgtctagctgattatgatgaaaagataaatgaaagtgacctttccctccaggttactttcagcatgcaacatattgtaattgtgtgaaactatagataacaaatgaggctcctgtacagtccattcaatcactatacatggctaagatgatctgatctgaccaataaagtttatgcctctatatcttggaagtttgaggtagtctccaatttgaatataaatttgactaaatggtatttcaggtttgaaaaataagttgaccaagactaattatgcctctatattcccagaggtgtatagctcatcggatagaggatcatgatcaattttgttcaggtgctggggatgataacataattcattgagttaaatgggagatctgttgcaggcccacaaatgaatgtggatagatcctgataactagctgtccaaaaacattgccatggcatttttctagagataaatattgtatggcacattaatttgaattatatatgatccttatccacagtttagatgtcaaagtagcagtaaatgacacttgcaagcccttggaatttttttccggacattttcattttataaatccagtttcattatcaaggattttgggagaatgggtgggtgatgcccctttctcagcttttccacatcgttttcagctcagaccccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccacccaaaaaaaaaaggatagcaaatagcagaataaccactgttatggatgagcaatcagagttttcccatctttacaaaaacaaaaacaaaaaatctacagccagatatgattccaccatgtatatgaaagtcatacttagatttgttccctttgcacaaatcaaataaaacttaaactgttaactattcattaaacagcacctgatcagttattcatcaaaagatttaagaaacatttcataaatcaaacaagtagaatgaaacagtaaaaacatgatcaaacagaacatggatgtcaaaacaatctacaaatatgagcttacctattataccaagaggggtcacagcagagttgtgcaaaagcaatcaaactaggatcagatgagaaggtaccaaccaactgatcaactgtgatagaaccagatccactacgaatgtccatgattgtatcagatgctttcaaacttgtcaggccaaacacctagatcaagcaaacaaataaagtgggttttaatacctgtataaacatgtgtagcagtatcatacactacgtaatttcaaccttgtgcattgcccgtgacagcagtgactggcacccaatgggatcatcaacatatgaacaagctccaacctttcttttgatgaaaagaataccagaattaaatggattattcttgtctccaaaattccaccaaggtttatctgttataaatgcataattggggttactcgtttaaaaagtatataattctaaaagcctcatatcagtataagatcacagcataatagtttatgtttaccttctggggtaaagtctaatacttgaggccagtagcgaggcccacaaacacgtattcttttcaactgtaaccatcaatgcaaatacaaattagtcctacaaggttacaaatgcttttctttgcttcaacaataagaaatatacaactccaaaagctatcaaatagaagttaattcaaaccgaacaggagaattgtgaaccaaaaaaagataaactgaacaagacaaatcaaagtatttcattcatagagaccatccaaacactcagacttacaattgatcgttctggcagaaggcaaggggtgacctcgcaaaagctggactctgcataatgctcagtttctctgactgtgacttcaagaggagcataaacaggcagaccagtgtcaacatcaactgtttgaatccatcgtgcctctgttgcaaggacatagagatggcgaaatgcctgcaaaaaaacttttttcagaacttaattttcaacagtaaactaacaaacatttaagcctttatcacgagtaattccatcaatctgaaatacctgaaggtggcatctgttatcatttggaccagttggcaagcgtggatatagagtaattagcaaagcagcaatggaatggttgtttgttgaaaatgttctcattccaccaccaagaaacaagaaaccagtagctaagcttacctaaaacagcaggtttataaaacaaataacggagactgaagaaggtaattaccaaactcatgtgaaaaaaaaaaaaaaaattagcatctacaagatgttgcgtgaatatagatcatgtaatgatgtaaataaaatttgttttaccaaattaagtacaggaacatatgaatttcaaattgattctttgatattactatcataatacaagatatctgaatcaccaaaagccctctgattgaagataatttttcactgattcttttatctaaagcccaactgctaaacacaaacatttttgcataatataggcacaaaacttgtggacatgagataaaaagacattttgaagatcattagtcgcttagcataatggtaccaaaccacctccagccacttaaggtagggcagttcaatccccagccccctggaaattcaagttccaaagccagcctctcatatatatcaagattttattctttaaaataatgaaaattaaaaaaatcaaaagacaacttgcagaacttactgccatctgaataccataacttgactgcccatctgcacaatttctgctccttaggaatctcaacaaccgaaaggtctgtaaatgtccagacccagccataacctggtatgcagaagtttaaccatagaattttagtcatgatcttaatcaataattaattgacaatggacagaaggaagaagcaggtaccacagatagagaaagaacaataaggtgaaggcatgtttccaatgtgccacgatcgatgtagcgagacagtccctttgggaaaacctttccacatgtaggagaaacaggcttcatctgcaagacaaaaataaaccatctaaacctaccacttcacatgcatgggggagttaggcagcataattctggactgacctcgttaagaaagtaaatagcaaattcataaagtaattcctgtgcactttcatttcttgtgccagcaaacaccagtcctgacaaggttaagaagaataagtttcaagacaaagactaaacagtaccacaaccactgacttgtcagaataaatataaaaaaaaataaaaaaaaataaagatagaaggaaccttgttaaagaaaatatcatcaaggacaatagtagcaatgaggatttaaataatttcactcggttatgatatgattactttttcatgtaaagaatttagataatatcaacatactaacactttgttaaattcatcataaaatgaatgcaaaggctagagaacattttaccaagtgatatacaagctccagctattatattaacataggcctgtataaaagcctcagtatccatatcatcaatatcattgtcatcacctccaatcccttctacagaacatctgacaatctcaggaatttgagaccaaacccaatcttttgagggatgaaccctacaaaaaaatatgcagcaagaatggatcagaagggtgacaaacagatccaagtagattgttgcaataacttaaagaaaccagtacaaacctgttccacattattaaatttcgagcaatgactctaagcattataaagtcaggcctcacatattgcaaatcaaaacatgtattgggaattgagagcctagacacaatagcctcagattctgtctgtcaaaaaaataaagaccaaagttgtaaaaggtataaaacaaattaaattgcagtagataaacagacttcttgttgccattactactaaccttcataaacatcaaagcaatggcaatgatggctccaggtgcagtgacatcaacattgactgttgtcccatccatcatctacaagtacaactgcttaaattagttatgcaaaagaaagtctcaactataatgtctcatacgattttatttctcttttatttcatcacggaaaaaatacgaattgaattctctaaacctgtgcagaaccacgacattcatccattgagactgtcgaaaaatgagatctttcctgatgcaaaagtacttgagcattatataaaattataaacaatatcaacaaggaaggaaagaaatgacagaagaatgtgaaccccattacattgtgtactttgtcaccaacgtagagaaacagacgattcacaaatgtgtcaatgaaaccaagtgcatcttctccccgtccttcaggtaacatattttggttagacaaagaaccacaaaaccaaaatccaaaacctattatttaagtattcctacccaatgcaacaagacccagtgcaaatcctgcagaaacagcatgaccctctcgctcaagaacattatcacctccacttcggcacccaatttcaccctgaaaaaattacatatagatgtaggggaagaccagttaaaggaagaaattaaattaaacagaaacacagagacaaacaatttagtaaatatggaaatcctgcaaaccctaatcaaccagggaacacataggtattattatttagaatgaaaaggcatcatgcaaaacaaaaaagaatcatgaaagaaatttatgaactggtactatggctggtttgttcaaaatacagaccataggatctgtacatacctgacagatactatcatgcaagcaaacaactttgataaaccaattcctaaacacgcaagtgcacaaatgataatgaattacaaatatatcaaaactccaagctaattgcatttaatggaagcggaaagaggaaacaatattgtaaatcataccaactggttaaatggtccaagaaagcaatagaattcagcacaataaatagtaccagttcaaccataatcaaccttcatgttcgctttatctcgatggcatgcaagaattaaataactcgggcatatgttcaaccattggataaacagcagatgaagacatgaaatatatttaccaataaaacctgcattgtttgtgggtgagctgaaccttcatataaaatccccaaagacattaaagcggctgactgaaaaaatataaatttcttcatgagataaaatgaagcaagtgaaagccccagctttgggcttttataatttttcttctgatgttagaaagcaccagcaaaggagggagggggtgaaaagggctaatccaaagtgaacaaataaaataaacataaaagatacctggagcaaggttggaacctctaactctggataggaagatggatgtcgtacaggaatatgaaaataaagtgtctgcaagtgagtaattttatcaattctcccaacatagcaggcagaagggatgagataaggggtaagtatgcatgctatcaaagaagttatgcaatataaagatgctgatttcatgcattaaagggcacaaacaaataaaacacaatcttctataaataggttaatgttaaaccccaaaccaaggtcattaaatcactattcaaattgtgaattgaaaattgcattttttgagatctcacatcgagtagtgggatccgataaaccaaggccctaaatccaaattctaaaaatgatatcagaacctatccttaactcattatttgggtcacccatattttttagtctgtctattcctaagcatgagggggtgctgttattggatcacctgcatttgtctggcacataagtctgacaactcaggtgacaattccagccatgctttggttcactctctggtttgtatcataggagtggctgggtcatcaattcacaccattcaaattgtgaatcaaatgatttctataatactccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccccccaaaaaaaacacagaacctattattctgtttccttgttttggataaaagaagaaatttataaagacagagatcatgtttgcaaaaattaacagtatacattgtaagggagggagggagttaaatctaaattgttagcctagaacaattagaaaagaaaccaactcaatccaattacacccgtcatttgattcctaaagccaatcccagtaacagaaccacagccttgaattcaattaattttaagaaagttgatagtcactcatcaacaaattagttctaagtaaaataatacaattaagaaggcttattattttatttcaccacgctcaaattaaaatattatcatttcctcgtgctcatggaaaacaattgaactaggcacatcccagatttaattttcatggaaaccatgacaagaatgagtgttttctattatactccagtttgagatgcctccgatttagttccattagattaaattaagtgtttttgcaataaaagggcaattgccttcatgatcaagaaaaagcaatgcaatcataagatattttctattgcacttcaactatgatctagtatctgagggcagagatctgcaacaatttcaccagaaaaattgtgcttgataatacctttgatatagctggatgcatggtgcctccataagaagctgcaaggccaagcattaatcccacagtagtactttcatgctcctaaacatatgtagggaaaataatttgatgtcataaaaaatggaaaagctgaaagataacaatataacataaaaaggaaagatagacaaattgtccccaagttaattgaaattaaatgaattatatggcatcaaccattttgtggtgacaatcgggcccttaaaaccaaacagtttattgattataccatttgagaattcacgttccaacttaagttttagttcatttaacttcattctgactccaatgagatatttgagtttaaaaaaaaacagagaactctacaatcaacactgtgtctattttccttcagtgactataattgtctacttgcaccttaccaacttaagattaattgtttctgttttgtaacaataaatcatcaacattagaataaatgaagtgctaggggagcattagggaattaaacctgagaaaaatactggtagatgtcagtaacagctaatacacgcagatatccatgcaatcctagtgcaagtagaagtccagcatgaacagaatttggttcctcaggtttgttatacaaaatccatgttcttgacattcttccctgcaaaaggaattatatgcaattttcataaatatgcaaccatacaattatgcaagccacaataacaaatactcaaacccaaagcttgttcagtaacaacatagttgagagtgaaatattgctttaaaacaatacgatgcctcttgagtttttggtatgcgtctctaatttctgacagactccattaatggtctgcttgttttgctaaaagaaagggacaggagagccccaaaaaagtactttgttaatttttaaaatagtcccagatctggacaaaaagaagcccaagggtcaatataaaacactgaaattttgttaccactaaacaacaacaaagatttatcccactagatgaggtcagctacatggatgatggatcaaacaactcgacataattaaaaaccaaagtttcaggttgcacaacacaaaaagtgaaaaaggacaattaccccttcccattgtgtgtgtctgggagttgggttttggaggtaaagggaagggtaggcagggcaaatttttcatttcacaattctaataaatattttctaatttgataatttaaaaaaatgataaattatcataaactagacgtcataatctttttttataattattacacaggtctcttaatttaaaaaataaaaataaaaaattgtcctcctttcctttccctccaaaaccccactcccaaacaaactcttgtttcctaattctattgtgaggaaaacaatgccaacataaaaggtattatagtcttatcttatgatctcaccaaacagctcctataccaataatatactatgactcaacaacttgtaatgtgctgttttgtttgtttgtctctccatagtccatacacatcaaataccgaaaatactttaacctaagtggagggcaaggggcaaaatcctcaccctatgagcttgctattggagttgagttaggcccaaactcaaatcctaaaaggacttaacctttctacacttatatacatctttgcttgtctatatttttttgatgtgggactatatagttctccaatgaaatagaccacggaagaatagaagagaaatattatttccttcgacaagtatggactgattgagcctccgaaccaaaaaaatcaacatgtgtctatcaatttcatattaaaatatttgttcaatttaaaattttaaaaatttacactctttccacatttaccctttcgtacacgatccagactgttacacgcacgacctggcaaagaatgtgactactcgtcaaaacacgttaagaaggtagaaggcgacgagggccttcaggatgttcttgcagaggtttgtttgccacctttgacacggatgagcatgttgccgtcgctgaagcagtgatcgtcgaggaggaggatgggctcgaagcggataggggcgttcacgggtatgcgaacccgaattgacccaaaccgatccgaacagtttaggttgagttatttatgtatttggaccaaaaccaaaccaatcaatcaaaaccgttcctatacaggttgaatcatgggcttagatttatagatccgatcaaaaccaaattgaaccgatcaaaatcgataaaaaaaatttagaattgtttggtttgactttaaatactgctaatattgggactctaagtgttggaactgcaagtgttgtgactactagtattggaacttcttaaggtattactttcaggtacattgttatttgttttacctttttttcatatttattttttctgacatgtttataatattaatgaatcatattttgttcatttgtttcagcaaatctggttgtagcaaatctgattgcaacaaagcttattataagaaattaatttgtagaaaatagttgtgatatagactattatattaaatctcgttgaaaaatattttgttttaatttgtattagtctattttaaaatattatgttaatggtattaaataaatcaattttactactttcaaatatttgataatattgtgttaataatattggatatttggatgaatcatgatataaaatagtagttctaagaaaaaaatatcaaatttaaataggtaactcgttcgctcaaaccgaaccaaaccgttcatgaatgaattaggttgggttaggtttcaaaaaaaaaattgtgaaaatctaattgaaccaaaccgatcaaatttgattgggtttggtcctgaatttgaccaaaaccggcccgaaccagcccatgaacacccccttcgaagtggaggatatttggttccacaaatggaaggccatatctggttttgctcgcggcatgctaaaaaaggcaatatgatggaaccagttttataacaaattctatatgcgacgatttacaggtcaatcagacacagcaacatagtttctgtttgtagaaattcaaaagagaatggtcctgcgctggtttgggaaattgttggtctattgtatatttttttttttttttatcagcaaaagataatatatatatatatatatatatatatgaaagcagtacaagaggtactgctgtgattacaaaaaattgaaatctacacagaactttgatggctttatctcaaagccaacaaaggtctgacaagatctctcatgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaacccttcccagctatgcaaaacactctcgcatattggacgaccaataatggaaaggagtatcaaaatccttctctagattcctcagccaagaccagcaaaagaaaatggcatcttctaagagtttgtgaccattaaacgtttcattatggaagaggatttgatttctatgattccaagtacaccacgttagtgcagcccaccaagatagccacctgtccaaagctttcccacgtagatgacagaaagaggattggttgaaatgctcctttggatcacaggagtaaacccccaaaaggtttgcccatgcccaggactcccaccacaaaggtaggattctagggcagctgaagaagagatgggaggcatcctcctggtgattattacaaaaaggacattgaatgtctgttatggctacatttcttctcctaaggttgtgtcttgtaggtagtctatctttaaataacctccatataaaacatgctactttggttggtattttcagcttccaaagaaatttgtaaacttcctcctgtgtgtatctgccctcctcattactaagcatgtggtatgcactattcactgagtagtttccattagattgtgctgtccatacccaggaatctgctaactgttgattaattggcaccccctgtatgtcttccaaaagtgatataacctgctgaatctcatgctccctaaaaggtcttctccattgtaaattccaatcccagccatgctggttctgacagcccatattctgcataaattgttgttgctgttgtgaaatctgaaaaagtctgggatatgtatccttcaatgaagtccgatctatcttccactggtcttcccagaacagtaccttgctaccacatccaatcttccacctcaggccactaaaaaaccatccatcaagctgtactgatccataagccaaagctaaatctttccaccatatcgaggctgatggtagtgtcgaggaagtctgtatattcctccagcctccgtatttagattccaagatttgagcccataaagcatccggctggtgaaataggttccagcaccatttgcctagcaaagcctgattaaaaacctttaaattcttgatgcccaaccccccattctcctttgagagacacactacttcccagttgacccatggaattttcttctgttcttgattagtgccccacaaaaacctcctctgcatcctttccagcttagttatcacttgccttggcaccctgaaaaaagaaaagaagaaaataggaattgaggtaaggacagccctaatgagggttacccttcccccaaaggataggtatttgtgtttccaagtggctaattttcgctcacactttttgatgataggaccccatgttgccccacaccttggatttgccccaataggaagacctaaatagggaaaaggtacagacattatgccacaattaaggaggctagccgcagtaaatatccattgatcatccatcccaaacacagcgatgttacttttattacagtttaacttcaaccccgacaccatttcaaagctcatcagcagcacctttagagctttcacatttgctatagttgcctttccaaagaaaatggtgtcatctgcatattgcagaatgctgacatcagattctttattccccaccttgaaaccttcatacagattttttgcttgtgcctcccttaacatccctgttagcccttctgctgcaatattaaacaaaaaaggggccaatgggtcaccttgtctaagccccctctgaggttgaaattctgatgttggacttccattaaccaatatggatatagaggctgatgataagcaccccttaatccaggatgtccatttctcgcaaaaacccattctcttcatcatatacaagagaaaatcccagcttactgagtcatatgctctctgaaagtctgccttaaaaatcacacagctttttctactcctcttagcttcttcaacagcctcatttgcaatgataacactgtgcagtaattgtctcccctcaatgaagccagattgtctttcatcaatgataaaaggcatcacctttttcagcctgttagcaagcaccttggccactattttatagatacagcctataagagagattggcctgtagtcatataagctttggggatccaacttcttaggaatcaaggctatgaatgatgcatttgatccttttggaaatgtcccatttgcgtgaaattcatccaggaagcggagaaaatctggcttcaatatatcccaaaaagcctttatgaaattaaaattaaagccatccggtccagagcttttatcgctgccacagctccacactgcctcttttatctctgatgccccaaagggagctgtcaaaacactgttttgttgaggatccaaagttttgagctgaatcccatctagtttgggtctgtcaaaatccgattcttggtagctgtctttgaagaattttgttacctcctccttaacccttcccggctcttgaacccaacttccattaattaatactccttgtagcatattcttcctgcgtttccagtttgcagacacatggaaaaagcgtgaattacagtctccctccttgatccatttcgcccgcgccttctgcgttagtagagatgcattggcagttgctgcctcccagagttcctcctgaatttgttttcgcttctttatttcttcttcagacatttgcctatcttctgcttggatttccatggtgtttagttccttctctaagtctgtaatcttctgttgaatattgccaaactgttctttgttccagatcttcaacctctgtttcagtagtttaagcttctcttttaatatgaagcctccccagccaggtttcctatacgagctgcacacatcagctatgatttttgagatggatttgtcctgtaaccaacagttaaggaacctaaaaggctttggtccccaatcagcctgtgcagattttaacacaatagggcagtggtctgagaaattgcgatccagggctgtttgataacacccctgccatagagacgtccactcagcagatatgaatgccctatccaatctgcttttggctgagccgttcggtctataccatgtaaattttcttcctagtctggatgcctcctccacatctaaatcagcaatccaatcattgaagtcttttatgctgcttccatattgataattctgccccaaacccagcctttctgatggtcttctaatatggttaaagtcaccaatcatgcaccataagtcagcagcatatgttctccttatcaatttgatctcttcccacagagattttttcaatgttgcatcacaaggtgagtacacatttataattgtaaccttcttattttcagtcaagcaaaccccttccagataaatgtagccattgcctttcaaccttttttctaccttaaaggtctcttcactccatacacatagcagccctcctgctttattaattgctggctggaattcccacataacatttgaatctccccacaaggcttggcaagtaatctttgtaactatttctttcttggtttcttgtaaacataacaaatcaacttgttctttgctcaccaatttccttattgaactccatttgacccccctccccagaccccttatattgtatgatataatcttcataatttcacctcctctcctccccttcttgaagtctcccccttttctgctgcctccatacccagaaatcgattaataatatcctccttataatggctggttaccccgaattgttgggccatattccagaactcctcctgtttgggagatgaaaagctggatattgtttctgtgtctgagtttgcaatttactttaatcccacctcaccttcatcctctttactcccactatcccccccaggctttgtgggagatttatgtctggatagcacggttatgtgctcattcccttttgtaccacttactgcttgctccattttcccaattgtgcccatcttttgtccggaattattttccactgctaagttggtttggcttacgtgtatcagctgaggcctatttttccctcccttattccttgaatacacttgccattgaggcccaatacctatgtggcccatcagacttttattaccttcactatttgttttttcacatatctcaataggtccctcagctgccttctgtacctttctgaagttggccccatcattatcgttcttttctagtgggtccctccttaccccagagtttccttctttggtgacaatctgttgtactgcagaaggggtagtacaactggccaagtctgcaccatgcttgtttccgtctggtctctctagccttggacttgtagcctgagcccctatgcagtctacatcaaaagcctggtttttaggtggcgtctggtcctcaagggagtccgacacgacctctttctctgacctgctgctagtaccacttttttgaattgaagcacggtccgcaatgagttgccccggtccatcgtacaaggaccgttggatattctggtctccaccgtcacttccatgggttttttccaacaccacctccgtcgtgcctttctgcgagcagtagttgtcctccacctcttcactctcaccctccaagctgtctactgatgtgatttcatcagaagcttccgcctggcatcgatttagacacccacatctgaccgagttcgcatttgtctcttctgtgacgaagattggaaaatcgattccgttaatggtggccacaatgttgtgtttgatgatgggtgtccatggcgttttgattaacacacgcgccctgtccaggcgttgcagatcttctgtgtcatcatccacttcgaccaagtccccaatggttgccactattttagccaggttggtgaggtcccacgcgtgaaggggtatgccccagcaaaggacccataccagtcgataagctggcttcaatgatggcttccatttctccagagaatggaaggcagataatcctagcacctcttcaccccgacagaaagcctgagctttaggatcattcaggcccaataacaacaccatgtcttccccaaagtatctcggcctgatatcttcttctccgtcccaccccatttcgtcttgcagcttgtcgaacaggtttaacttgctcagccttcctacccaggcgtcctgtacccattttttgtcttgtatctgaacctctagctgtattgtagaggatgttgatttggtaatgtccgctacatgcttcggatacctccaatttttaagattatgtttgggtttggctacaacctgagcgtatgatggttgctggtagggttgtctatgattgggttgaaaatatctggagctggtttctgtcctcgcttcaaaggcgccttggtgttggtttgcttgtgctactgctttcccttttgcagcagcgatgcggccttctctttcatgctttggaatgttagcatgtagcttgagccctcctattattagattgtccaaagctctttctaagttcagaatgttctttacacctttgaaccttacaaacccataccttctgcctcctctatttctgttttttgctataaaaacttccctaacatcaccccattttttgaaaatggaccacagctctgcctccccaatgtcctccggaaaacgtgtgaagtagaaggaggatacatcctcgcgttctctccaattgatcgatcttctagctccaccgtgtgtcgtcgcctgagccgcagcatgctgtctgtacctatccccgtcgaacctataactatgtgaaaatctctctctacccaccccagagtgtctctctctagctctctctctcatctcaaagtttacatacacactggtctattgtatatttgaaggacttgttaaattacgcatttagttttgctctttttggtgggtgagcaatctgtttttgtactaggatttctggtagctatctgcataaacacttcctttttgggtgttctatgcgtagacacttatactttggatgttcatgtacatcgtgagtgggggtgccgcttcactgcttgtgatttggtaccttttacactttttaatatattttatttggcctttagaaaaataaagttcaaaagagaattgaattatgttactaaaattgtaaatgcaactgaaaagggcattagtgttttcaattggctacattatagtagattttggtagtgatgggtggaatttatctatacattgtattgtacagcaaatggtcttcactatgcatgaacattaatacaaatattatttgatgaattataagttaatgttaaaaaaataatttaatattaaaaaataatttaaatattttcatttaaatttaagtctttttaaataaaaaatttatcattaatacaaaaaatataaaatatattaaataaaataatatagtcaaaattaaatatactaaaaacattaaataaaatcatataaaaattaaaaaaaatatattaaaaataatattaaaaatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactttttaatttaaagccgtatgttaaaaataacatgacttcagtttaaaaaatttaaaaatatatgttacgacttcaaagtcagaaattgtaataactattctgacttatcccttattctgacttatccctttttgattaataatttaaaatatacctccaaacgataataaacaaaaaaaaaaaaaataccccttaatattaaatcttctgttcttcggttctattccaagcataatacactgcatttgtttttttagaaccgaagaacagaagatttaatagaaccgaagatttggtggacagccctcacttggtccacttggcgtcatagaaacagaattatttttcataatgacagcttcaatcatagcagattgatggatgatgcacttttcacgtgctggacatggcttaagagtttggagaaaggatttgacaaaccctttcacttttggtctagcaatttgagggaggcttttgtaattaggggaggggtctctttttaattttctccctgttttggggttgacctacaccctttacagttttatggcttgttaattcattctcttcatgtattaggaagccataggcttgtcttgggtttagatattttgtaatgatacttttggtatcttaccttttattatatatatacacatatttatctttgctgatcaaaaaaaaaaaatatcattttcgaatattttttttccttgttctttagttaacatgttactcttcactcctcacataattagtaggcataatggcactaaaggcatagactattaccattgcgaaacaaaatggaaaccatgctttgctgagggaactttgctgcattgtgcgtatttcttgtgctattaacatgtatcccaagagaaagtgctcaagatagctcttgcctaaacaagctttctactgcctgaactacctcaacggcattgaagacccacctaatagttgctgtgagccacttaaatctgtgattgtatcagcactacaattttaaaaaatgcaattgcagtagccagaagagagattcgggtttggagcagactctgaacccacctttgacttcttggttaagcctcaccgccttctttggcttcccttgtttctacatttcatctgagctttgacaaataccatcgagcttagcatcaaccacaaactgcataaggttgtatttgccgaccaccagccttggtgcctcaggttcgggaagttgagtctgggaaattcgccttgccgaagatgctttgttggtaatcattatcagcatgcgtgtctacgtcaagggccccacacctcttagatctgttgtacgtgtgtgcaaaagtctggggcaaactagggtgtgatcacgtgaggaagggtaattctggaaagaacttacattttaaatgttaaaggaatatttgatagtaaaattaaagacaggtgtcaatttttttttgtgccagaatatcttccggctggtttctggcggaggatatagcatttctcatagaagaatactcaagtaacccatataaggtcaacaacatgaaaaaggtcttcttccgcttttcaagttcttggtatggggtgtaagccgatgttgttaaatcgtagagtctaggtagactcagtgggatgagctaaatcgtaaaatcatagaaacgtaaatcgtacataagaatttacttcatataaaaaaataaaaataaactgaaaatctaacattaaaacacaccaataaactgaatatcccattatttttggacaaaacttgcatttcatttttttagttcctggaatttcaacaacatacttccaaccaggatctgttctatttccaggagcaacacagaatcctcaggaagcaatcacaacacagaaccctcaacaattcgacagtctcaatctcaatacacaacacagtagcaatcacaaacacaaacagtcaaacacactagcaaacgcacaaagggagggaccgagggagaagagaagacgaaacagagagggaccaagggagaagtcaagaagcaactagcaaacacacacagggagggaccgagggagaagaccggagatggaaaacttacctttgggcgcaggcacgagagggagaagaccggagatggagaagactggagatggagcgcgacgagagggagaagacctgagagcgccgagacgtaggtaccatagaagagaatgggttttgaaaaacctattttttttttttttttaaatacacactgagtcaactcagcgattcaaccgagtttaccgagtctatacacatatccgattcactaccgagttgactcggacgagtttaccgagtcaactcaacgatttaacaacattggtgtcagcaaggggcataagctcattgaagtcgtgacgagaaattgtcattgcctaattaccataattaaggatatctagcaatatccaacaattgcctaattactataatcaaatatatctacaatatctaatagtcattttaggggagttaggagtgtccttgttagatctcaagataaattggcaagttgtgttgcatgtttcttaatgtttttatttattttaggttgtataatctttaaaccttaaaagattttttttttttttagttttttataatctttaaaccttgaagatttcttatcctcttttgtatctgcctttcctatcttaaaaaatttctttcttatcaaaaaaaatatatataatttcctagcagaaacaagtttaaaccattcaaaactatgtaaacctggagaggggctagtctaagtccagcagcaacagcattatgaaactcaggccacgacctgagttcttgtatgttcctgatgtttggatcaagattaacctgtgaataaacaaacatgactcaagtcaacaaatacaaaaactagtaaatagtttcacaagccaaaacaggcattacagatataatcaataatatgatatctacttacagtagcattctgttgggctggcaaccgacctgctaatataagctttggaacggtaaaagcctaaaaattgtgacaatttcaatcagaaagagtatatttccaaaggtaatttcaaaattcttagtgaaggcaagtaggaatataaaaagttaaacgtaaagagcacctcagttaagagtgtatatatggttgcaagggtaaatgccccacgtccaacaggaagtgaagtggtcctttgtgcaaggtgccacagttgagccttcataaaaaataaaataaatgtatcaaaggcagatttatatatatatattttaaaaaagtatacccgttcaacttgagaaatactccctccgaccctgtttataagacataatcaacaaaaaaaaattgtcccttattacaagattttatttcatctatctatcttgtgcattaattgttcttttactaaaatactcttatttattttattataaaaaatgctattttgaattgtcactttctccctcctatgaagattggagaaaatgaataggttcccattaatgttgagggaaaatttgaaaattattacaattagagacaattttaatgttaatacctaaattaactatttttcttaataaacataatttagtcaattatgtcttataaataataagagaatataaattacaaacaggaagcaatgtgcagcagataattaaaacaaacttggccatctttttcaagaacagaatttgctaggagagaaaaaaaatactaaatgaaaaaacaaatacaaacatagaagaattaaaacatagcccacaattgggataattaccaactcaagaaagcctttccctgtataagtacaacaagacaatcgtgtacaatatgcaaattacaaatttcttaggtttctttagtttggtattgatttaatttagttgctgtaataattataaatgattactaacgtaaaaaaacaccaatttataacaatctagatttacttttttaataaaaaaaatcattcaaaagggagaaaaggtaaaaaaataaacattttcctttagttatatataccatactagttgaatcaaaaattttatttttaacattcataagtaattatttttacgttaccttaataattaaatcaaatagtgtcctaatataaaaaccataacttaacctcaatatgatgataataacaaaaatcaactaaacattaaaactcggaagaaatacaaacttatgacaaaataaacgaagaaatcaagggaacacacaaccacattatgtgaccaaagaaatgtatgaaaagcccaattatatgtaggatgctaaagtgtcccctgaaaaagaatgaattgcttccacaagtgtgtgatgaacatcttataatggggagatattttttacataaatcaggcatgttacacacaatgccaagaattccacttaaagttaatatgacagtgcaaaacagtagatctaatttccaagttacatgtatgtcatagtcaccaagttcggaatcattgcattgggtgtatataagaatttttacaaaaggagggtgacaggatcagacttgctaagaataacaccgttgagtatattatcagatgcttgaataatcaaattataaacaaaactgttgacaatcacaaataaaacaaataccatggcaacacatacctgctggaggtcctgatcagaagcactatggttaacagatgtttgaattgccacaggtcttgaagagcacaaaaggcgtctaacctagtaaaagtagccagagccatgattcagataagaaagaaataagtttttaagtcacttttgcaccagcacataatatacatcaatttccagtggactagtaaaacgtctcaagatatcagtatagattttttttttatcagcaaaagatattatattaatagagaaaataataacagtaaaagtagtactgctatgattacatcctagcatgaacagtatcagaacagaggtggcttaatgcctagtgaagcatgagaaagacacctaagttctgactttatagtttatactaggtcctaagcctccccaaaaataatagaaatgtacagattaaaccctcccccaggaaccaaaacattccctcatattactagaccagtagtgaaaaggggagtcaaatcctaattccaaatttctgagccacgaccaacagaaaaatatagtgtcctccatctacttctgaccgttaaaagcttcattgtgaaaagtatagataaaatacatgtactgatagactgtagagaatgatcctttaagaattctccattgaggcatagtaacattgcaggttcagaaatgtcccatcaagtaaggaaaaacagtataaaaaatttcagatttctaagactataaagcagttgatgttatatgcataaaagcttgtcattaacaagtaccatataggactcttctctcctatcaatttttgttgttgaaaacaggtggaaaaaaaatcctctggactcactagtagctgttaaaatagaagattgtggatgcgtgtttatataggttaattacattaattatataaaattagagaatactatgtttcctctaaatcaaagattatgtgcctataaaccgctattatcaaatacattgatgggcaaaaaccataacctttttatatgatctatagacaagcagcaacagggattgaaaatatatatcaaggaaagataatcaaatcagtcttgttccaaagttcttaagtgaagtgccataactgacctcattcaacctaagatcacgaccataacgcaactgtgtgctagagttgaatatatgctccataccatcagtcatagacccatcaacggaatctgtatcctcaaactttgttccttccaatccaattgcatcagaaatagtagaagatattgtcactggatgcagatttaacatataaggagtggacattgatataacattcacattggttggtgtttcaatgcccctatatttgcattcacgtgccaaagttgacattgccaaatcttgtctgccaagaagtacataagcagcagctggccagtcattgggaggtgaatctcgacacttatctaatgcctagaaggcataacagaaaatagatgtaaaaaactctggaaatatatgttaaaacttaaaacttgctagagataatgctcaaagaagaactattatagtaatagtagtaagcaaaacacgtggaaaatagggtagaacattgtcccaggaatgtgaaaaattcaaacaaatataagaaaaacagtaggcaatgcctgataaatgagagtgccatcaagatgaacattagaattatgtaagatgacaggtaatttcaaatgttgaacatgctcctgaacaaattaatttgtaaatgatttaaaaaagttctcaaagccctgacagactgacatcaatgaagacaaacttacatgacgtagtggaagagatacaccagaaggtagtgagtccagctgttgaagtccaaatctttcatcaaccattgctaaaatagtaagctcctcctttgaagaatgtgatcccatagtaacgttacagtaaacaccagtagacagtttctttcccagtaatttggcaccagataatatgctataaaagcaaactactttccgggctatgctaaccacagaacttccttctttacagactaaagctggaagatcattaatattagcataattagatccatattgcaagcaattttcaaaccatctgaataaacttggacaaattttaggtgaaatggtgattccagacttcagaaactttttacagaggccagggaaatcacgaatataatggtccaagtagatgtcctcagccagaaattcagcaattttgcataacagaattgaaagaagctccaagtccctatagatcataggcaacaattatcatatagaatcaataaatatattttaagaaaagactaaaagtgggaaattaactacttggtaaaatacagcctaaagaacacaatgaaatgcttaaagcagatggtgttaacaatgtatggaattatggataaccaaaagacaatcaaattaaccttttagctgtcaataatcagaacacaaagcaaaagtttttcttgatcttatgatatagccttagcttggtaagtctggtggcatcctcacaaagctaaaatctaaggccctgttcgggatggttgccagtttgtggtttatggttttaaaatactattttaaaaccaaaacgtgttcggtaaaattggggctgacttggttttttaattgttttcaaaacagttttacccttgtttgtaaaacaataaaaattggtttctggagttttgttgtgagtttaccctaaatctcagtcccccttacgctgctatctctctctcttgacagcctctctctcgacgcggccctctctctcgatgactcgctctctcgacatggctttgtctctcgtttactctccctctccctggtggtcaccactcgccgccggttgcctctagtcgccgtagatcaaactttgtcacttgtagacaatgaagggagtgcggaggagacaaagaggttgcgtcgaagccaaaggagaaggcttgttggttggtctgcatgccgatgctagctagcgcagtgtctgcgtctatgattgcgacaccatctgtgcacgacagcaacacaagatctgcatctcaagttttgcgatagagaggtgatggatattcatagatccaagttgtttcatcaaatttgggtgttttggaaacctaccttcttttttctctcatccttcaagcaatttcatcacttctctgataatcattgtttgggatggatgaaaacctttatgatggatgagttatatggtttggtgcaattgttatctatacctacgtggtttgggggttattggctggaatttctttattgttgcagtggacatttccttttctgttagtttaagttgattatagatgttgtattttaattgaaatggagataataagaatttgtaactggatatgaagttcgaaatggaaaagtttcccttgttcattgattggtgttcatacatgatatgatgttgtaacattgttaaattcctccctttttttatttgtatagtaaggttctgggggacaaatttttgtattcaataaggaatccatttgaaaggttctctatacagcataaatcaatgcctatgaaatgcgttaaatacaaattaaaaatgcctatgaactgtttaatagaatggctgagaatggattgaatatttttggaatgttgtattgcaattgaatttatttttcttgcaaatctaactagtactttgaatcagatttggtaattgaaatttgaaagccgtgtagtttgtgtttggatgtgataagaaggattcatagataatgtctttggaagaagacagatgaacagaaaactaaaactcaacactcaaaactgaaactgggtttagtttttaataatttcaaaattggaaacagaaaaccaccccgaacggggcctaaaagattttgcataacgtgatgaagtagaaaatgacagatggaagtctctgcaaaaacttcagcactaacttttttgcaggtctaagactaagactgctgactgatgtatgatctttacttctagcaatttcaaacttataatagcaatgggcagatcatgaaatgatgagagaacaaagaaagatacaggagagaaatttcttcttttttctgtaaatactgctgtacagcgagttatttctcctgattgtgttactgttgttctggtacctaacaaacttatttgattccttgacttttgttgttatggacttatgtgtttagcttaagactgtgactttcaattattaattattatgaacaaattatgaatatgtctatcattttatgtggaaaaaaaaaattgagcatttatatataagtataaattatttaacttatattgtttctatagatttcagtacagcagccatccagctataccgatgttcaagttggctgttctaccttacccttaaacatgtaaatccatttaaaaaaaaacagtgacagaataaaaaatgcaacaggagcagggcttatgcaaactatcctttgtactgtcactactgtgtgaccaatacataaagcaaaagaaagttggtatatcatcatgaaatgaaagagaagaatagatgtagctacttagcttaaaagttggcctcaagctaatcaaatcaagctgacatttaaaacattgaatttacaactaaaagtaatatagattactgaccagattcactaacccaaccaactagctgcttcctaaacaaactgggcagtattaccagacaaaatgccgaataggatagaaataagagatgatcagaaaatgcattagctaggatgctagatactaaaatgaaaaggcaacccaaaatatattacacaggattagagacataccttttgcggagattgtcaagtttcaagctttcatagagtccatgaagagattccagactttcccttaacagatcagtataaaatggcttgtcaaaactttgtgtgccatctacagatgacctttggaaatttaattcctgctgatcaagtgacactgcacaaggtattcggaacatggagtttactttgcaaaaattataatgaaattggctactaacaaggaagtcccatgcagaatgtggtactgaatcagaacgcttttgacatataatgttatattttccgcagatttgcataattacatgacaaaaagagtcccattctgaatcaacaatagattcagcttctgacagatgagctggatcaccatctttccagagaagaccaagaaaatgtctgtaataactagaacgaagcccctcagcaagtgctgcgatgcaatcattagctaatgttgatgaaggactttgtcgtaatgcacatctaaagatctgcatatggaaagcagagatttcaaatgaagcaaagaaacggattattaggtttccatttgccaagaaacctacatatgtcaacttcaaggtaaaaaatgaaaagaaatcatccctaaatacaagtcaacatacctgtctattatttactatcacattgactcgcccctcaacagcatcagccaggcctgtaatctttaagtaattgggaagaggagattcttctgaaagctccaaatcatgcaaactcttatctttatttaagcaagaaggaagcacatatttgcacaggcattgcttcccagactacaatataagcatggcatattactaaaagaaatatcaaactttagcaatcttgatggcacttgatggaagcatgaaaaagggtgagtctgagaaagactgataactttgtataaagtataaaaagtcaatatgaaaaagaatttctacaaattaaagctgccaagtttacagctccatttataagaaaccatatccaggcattatggtaacatataggtcaaattttataaggccagaacaagttatcagatgtagcaccagtacttatcagggaataaaaaagtatctgtcagtagacattaataacctacctacaatatcagttatataccaatcaatgaaactaaacttacaatagtactaagagaggtagtacccaaaatttagcattaaaaaataaaataaatgtcacttcaattattcaaaagtaaaatcagattacagaaagaaagcaatttttatatggacacattaattgaaaaaatataaaaacaaagcaggagaatcaggaaccctactaagccctaacagcaacaaaaaaatgatgcaaccatcagctcaaaagaggtctcaaatccactctatgcaaattgcaaagaaacctttattgtaaaaaatcaagcattaacccacacggaagctaggaaaagaataataatcaaaacacaatataatgacaaacaaatgtagagataggatagtatatagactaagagaaatgccaggagccagagtcaggacactaaaaagattgaagaatgacacaatcaatttgtgtccatccatgtgtaagacttacatagagaagcagaacattttctggagccaaaaccattatgtctgaatatggaagtagtcctactttgaccctggaaaacacatatttgaagaaaattatgtccatcattataaaatcaatgtacagatagatgggatatgtaccttgggcgggttaccgtcacaggtgcagctgcaattgcagataagttccagctcatatcaggtttgacatcaaacacaatctcattatttatttcaacaatctgaagaccaacagacagcaactttctttgttcttggtgaaaaaagcagacaacaggagctgtatcatcatcagtggccataaagacctagtagtcatttgaaggaaaagtcaaaagaaaagaaataaaattgaatgtataaactaaatgataaaccatccaaggaggaaaggagaatgcaatccatccatccagctatctaattaaggacttgcaatttcactgttcggtgtaaaatctaaaagaatctggagagatttagagaatgatctaaactgtatttcatttcatcaatcgatttgattacaagatatgtatttacagagtacaaatatagagcactagcactaactgactaacagctgttgtaagtaactcaacaggtgacatagctaactgagaggtaactctaagctacccgtaggtctatactacatacactataacctatacggaatatacactatcattctgaactaaaaatctgaaactccaatgaataaaataattcttcaaacaacaaaacagtgaggcattttggttaatgtagttaaacaaacatcattaatagtgtgtttgaactagccagttagcttttttatgttcaaatatcttacaaccaaaatcttaccagtgttgttaaaacattttctagtttgttcttgatgattgatatatgtcattattctattttatctatagtctataaaaaattacgtacttcattgcccagaggctcctcgctaggtgaaggtaaaggggaggaatattctacgcagtcttacccttgcatatgcaaataggttgtttccggatcgaatatatgaccaacaagtcaccaagacacaactttaccgctgtgccaggactcgtcctctattttatctatagtctatagtagtataaaaactattcagccattgccatgtgttgactggccagtgattttttttttttcttcccacttcacactctctctcctccttttactctcttttttctgtttttctttaattataaataaaaaccatgcaaagcacaaggcactccctagtttattatattctgcagttttttagtataaattttgtgtgtaaaatattttttattatagccaccatgcaagggcagggagtaccatcgcaacaaggtggtcctcttctataagcagattatgaaatcaaataaaatattattaaaaagcatttgaataattatttttcaagtactaaatatgttaaactaatgaaactttaaattaacaaagttttaattattaattagtcatctgctatgctagaaatacagataaaacagctttgaagccatataaagcatctacattctactctacatttacatatattaatattaatacttgaaaagcaaagtaagcaactatgtcattaactgatgaattgcacttcccttttaaaaccaaaaaatgcacatacaaataatagccagataattttgaagaagcctaatagcctatatcacaccttacaagcagctatctgagcacctttcccctgccatattttacggaaggacaaatgttttggcaatacactcatgggatctatatgtaataaactagtggccggatcctcatcaatgttagagctgacaatttctgcgacccacaaagagtgctgcatctttcctgaattcagagtaacactatcacaaaaattaccaagacaactaccaggaactgatagcaagaacttcaatgaaagaaacctttattataggatgccataagtgggacctgatcacttgtccaaattgtcttttcatcatattccttcatcatgttcaatttccctctttcttcaataaaagttggctacaataacagtaaaagtcagtaatcaaatggaaaaggtaaaccaaaaaaaaaaattatagcagtaaatatgtcacaactacacaaggataacctagaagtaagaaatttcagcaacaatctggagattgttaacatactcgaagttcatccagtggatccatcaaaatgagatgagaggataccaaagtaccctcccccttttggatatgatgagatgcactaagcagcatatcacgtgtattaagcaaagggcttgtagatgaaaaaggaacacgtgacggtatatttgcttcaacttcttgctggagtaataaaccaaaaggaagaggccatatagatgtaattgtatgaggaaatggaagtgatactacttcacctgttaaacagaaggaaatttcagtcactatatcaccaaaaaaaagaaaaattgaatacatgaaaatattgacaatctgaaatatagatataatgatatacaagggagatttaaattgatgacttcttctctagtcatgaatgaaaagtgtgtgtgtcgagttgagatttaaaaagatctttgaatcaaagatagaaaacgaacatgagacatgtagttaattaaattccctgctaaagcaaaaaatgatggaagagactgtgcagatatgatagagcaatgagacatatagttaattcaaatggaaaggaacatgagacatatttaattaaattggactgcagttgcaccatgactgaaaacaaatatacatagaaaaactaaaacaataatctaattcttggattttacataaatgatatgaaataattaggacatacttctgcttttttaaagtaatttatgtcatttttattttttggacttaggaatttatcttagtttgactaagttattagagggcgaccctggcacagccttggtgacctgttggtcataagttcaaatctggaaacagcctctttgcatatgcaaggataaagttgcatataatatccatcctcatacctttgcatagtgagaagcctcagggcggtatgctagttttttcttttttactaagttattaaatattaattgactaaattaaaaaattaatccctattcttgacaccattttctgttttgggtccatacatgaaaagtctgcattttaaatgtttgctgacttgactaatgtttgtcttaccttactggctactaaacattagccaactcagaaaacatctgacactgatatagctttggcaaatggtaaggaccaatatataaatgttttttcatgaaggaaccaaaacaaaaaatggtgtggagtatagacgccaaatttttaatttaacctaattaatttcaataagctagtgtttgactgggattccaaccaccttttgactatggataccatttaaggtgacctattttattcacactttgatatttattaactccgaccttgcgggaaaaggcatcgctgttgttgtactttttaaattattaattaaagaaattgtgaaattttactagaatcccaaggactcttggttattttggttctagttctacatcaataatgagtaaaagaaacctgtttccaatgagagtaaaatgaagttttttgacaacaaagccagaaactagtaccattctcatgacataagttctttttctccttttctatcatatgatggtggaacttcatttattacacttaccagatgtattatagatagtcaaacaatcattttgtaatatacatagaagagcttcatctgtatgaccaagacgacaccagcacacctaaaatttcgaaacaaaattggttaaagcagaactgttcagtaaatggaacaaaaagcagcattacatttacaacaatggaaaataaaaaacaaatttgagacttttagtcctccactgttgcaatttctcgttgcacgggaaatgttgcagccatcggttgattggataaatttccacctccttagtctttgaaaacccaaagctaagtcaaggaagaatgttttgaaggaagactttattatgaggaaataaggaaagaaatggaataatataaaataacctccttaaacaaatcacatgtcctctaaccactggctgcaaaggaacaaattttgtttctccttgtaaggaataaagaagattaaagtaaacattacaaaagtaaagaacaaatacattgaaacacgaagggagcactaaaccaataaatttctttctgaaacactatagaccattttctctacagactcaaaccattagctttggcttcactcaaaattaaaataacaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccagacaggaaacaattcacacaaaaaaccgttctaaacgagatatccctccatcaacaatgatcaattcacttaacaaaaaatcgtagtacaggagttataaattactaatatagcgggttaaattaaacaaactcatttaattcaaattcaaagcatgaaaactcaaaactcaaaccttaacgatgtcagatgacaaggtaaatctcttaaatactctcgcacccgtcgaccatataatcctatcacaaaacatcacaacgttagataaaagcaatgcaacaacagtgcaacttcagacaaagtaataacaaagaggaacacaggcacagcagcaaaagaacaacacagaatttcaaaacgaaggttctaattcaacttcatttccgcacattcggaatcaactgaacagagaaccgagggttttattggcaaaagatgataaattaccgattgcctcggatgaacagctcgtgatccccacgattgctcggcgcagaagcgacgtcgtcgcaatcgtcatcggcgtctcggtctcgagcgatttcgggatcgaagaggaagtaatcgtacttgtcggtgacggtgtcggggggcttgccgtcgagagcttcggcaatgaggccaaatggcttgaactcgcccagcactgttaagcgacggattccgatggacattttctcggagctcagagcaagttcaagtttaagttcttctcgcgcttgagttcgctggtggtgacgagagtggaacagaagtactaagcttgagttcgcgcttaagatgagtgaaatgtgtgtcgcactcgcaggcagaactaagctttcgtctcccgctctttatagttttggttgattttttactttttagtttcgaatgcaagtacgcaactgggtctgggctttgaactttaaaaaaccctagctagacttttgaactagtaccgtaccgggaatttaattttttttaattaactaatctatttatctattgtaatcgttattgtaagatttttatttttttaatattcttccaaaagatacttttgttatagcaactctaatgtttttttttgtcaaaaaaaaactctaatgttaattttactatagtttgcttaattaaattttgtggatttaatatacatacaagaatgttaactctactaaaatttacttaatcattttttactctaataatataattagcacaattttaaaaattgaatcaatcattgatccagttatgattctgaatcactatattaatgattgaatcaattacttattaattgaactgtttgactcaatctttattaaaagatttgaaattttcataacatgtctaaaaaaacctatatagtaatagttattattattattattactattatttagttaattatgtaacatattttctttatttaaattattattatttactttattgtattatatgtcatgctttgaataatttttattactatattattttattatattttataattattgttattatttggttattatattttattatgatttagttattatatcatattttgtttggtcgtcatatgcattacttaagatttaagaaatatcatgtttacttgcaacaaaaaattaagtgggttggagaaaagatcaaggaagtacaggacacggatttcaagttgtggtatacaggtacaacctaaagtcaaaatggggttagaattataattgatagaagtttcaaagataaattcgttgacgtcaaaaggaaatgctacaagattacgatgattaagcttgtagtggggatctaattttaaatattcttagtgtgtatgcaccccaatttggactactttcaagtgaaaataacaaatttttggaagacttagaggaggttctgagagggatatcacgagaggagaatattttcttagaagaagatctaaatggtcatgttggtaaaaacaatagaaattttgatagaattcatggtggttttggttatggaacaagatatgagactagataagatgtcttgaacattgcactagtctatgatttgatactagcgaacattttttatcggaaaaatgagtctcatcttatcacgtatcatagtgaccaaaattttagtcaaatttgtttctttatggttagaaggaaagatagaaattcgtgtattgattgcaaggtttactctggagaatgtgtggcaacacaacataagttggtaattctagagattaggttcaacaaagttcttaatttgaggaagaaggctcaaaacccaatgataagatggtggaagctaaaggaggagaaacaaatagagtttaaggaaaacatattgtgtgaaggaccgtgagagtttattggataagctaatgaaatgtggaataagatggatatgtgtgttcaaaatgtggtaaggacggtgctaggtgaaagcaaaggaaacaaagttcttagaaaggaaacatggtggaatggagaggtgtaggaggttattaaatagaagaatgaatgatttagatctttacataaatgtctcaatgatgagaatttgcaaaaatttagagtagcgagaaaaaatgcaaagaaagaagtacgggaagctagaggcaaagtttttgacgatttgtataaaatcttgagagcaagatggtgaaaaaatatttacaaacttgcaaaaatgagggataagaagaataaagacctcacccaagttagatgtatcaatgatgaaaatcaaaaactttggtaagggatgaagatgtaagcgaaagatgactaaactagtttaacaaactttttaatgggaatggcggcaatagtgaggtggatttggagaactttttctgatgatctaaatagaagatttgtgagcataattaatacacatgaagttaaggaggctttaaagaggatgaagaataataaagttttgggacccgataacgtccctattaaactgttgaggggcttgagagatgtggcagtaaaatggttgactaatctattcaataagattcttcaaacaaataagatgtctgatgcttggaggaaaaatatgtttgtgcctatttacaaaaacaagagagatattaagaattgttctaactataggggcatcaagctcatgagttgtactatgaagttgtgagagagagagttattgaacatcgtctaaggaaagagaccaaggtttccataaatcaatttgaatttatgccaggaagatgtaccatggaagttattttcttgatgcgacaattaatggaaaggtatagggaaaagaagaaagacttacatatggtgttcatagatcttgagaaagcataagatagggtcccaaaataagtcttatggtggactcttgaaaagaaaaacgtagcattaaagtatgttaatgcaatcaaggatatgtatgataggttatcacgtgtaaaagcttgtaatggaacatcaaggtattttcctatcacgttaggtgttcaccaaggttcagctcttagtctttatctctttgtcttagtgatggatgaactaacgagagatattagagaggaagtgccgtggtgtatgctttttgaagataatatcgtgcttattaatgagaccaaagacaatgttaataggaatctggaattatggagaaacactttggagtctaaaggattcatgataagcaagagcaagacggagtaaatgaagtgtgagttttcgcgggtaaggtagaaatgaagatgttaaggtggatgtgtggttatacgaagatggataagataaaaaataaagatattcgacgaaaggtatcaatggtactggtatgtgaaaagatgagggaacataggttgagatggtttggacacgtcatgagacagccactggatgctcccgtaaaaataaaagtttgttaccaatagctcgacacaaagagaagtagaggttgacagaaacttacatggggaaagataactaaacaagacttaatggagtgagatatagattggcggacggtatgtcttcgaaaggagtggagaaaagctataagcttgttggagggttaaacccatcagtagttttatgttccagtcattcccttttttagttattttccttttatttcttcctcttttcacccttcttttattttagtttatttttcctctattttatcttttttccaattttttcccctttccctttctctttctttgtcttattttcgatttatcattaggtttatataccaccaaccccaattaacttggattaaaggtgctgatgatgttggtgtttacttgcaaccaactttaggccaaggatatagtatgcaataaatgacatttatgtaattaagtggaagagattatatactttttatctctcataaaaaattatttcaaaaaataaatctctcataaatactaccatcaacatgaaaaaaaaaaattatgtgaatatgtaatggtcaattgagtgttgattaatatctataacttttgggagactcgaattaaatttcacttcgatgtattcaaactacatggtccaacaaaatactcaaacgcatttgcctatatgacctatatcccttggggtatgtttagagttgctaagatagcatggaaagggaagggcaagcaaagaagtgcattgtaatgtaggatttgagcagtttgggaaaatcgaaattgagccaaaatattttaaaaatggaatggaacccagaacacagtatttttcctctaagatgtgaagacaataatattgtgcttacgaaattacttatatgtccctatgactttgtcattttttctccatctgctttccctgtttgcatgcatgacttttcttctccatcgtcggctcctatcaactactatagaagctagtttattgtttttttttttttacaatttacatgtcctaaattatctcaattaatttgagcacctcgttatttgtggactttgttcatgttttgagctgagttgtgtttgtaatttgtatggttttattgtgcaaaaaaactttgctcgctacgctgcctcaacccactgcctttgcttgcagattggttattattgtttgttaaaattgtgttttgcttctttttttttaattataaagttttacttattaaataacttttatttaaatattgccctttattttcactttccttcttttcattcaaataacatttattttattttattttctcacctacttacttcctctccttctatttcttctcctcctatataaacacacccttaaaatcgtaaatcactatcattaggcagttctttgcactctagtgttgctgcctcttcttttttaaaactaaaagagagttcaacgcagtttagtggtggtaggagtaatgtgccaaagctcttgggtgacagtgtgaatgcataacctttccagatatgatttcatgtttttcttttttctctttttaaagatgttcaaataaggtaggagttagcaagaggaaggtggcaaaactttcctacgatggcacaaacgtcctcctccgacggtgcaaacattttgcttgcgagcacagacacataaccttactagttttgaactcttattttttaaatgcacgaaccgaactgggtcgtttcaacttgttggttcgccaattcaaccacttaaacagttgagtcataatgattggtttacatcggttttattgcatgttcagtctaatattttgctcgacccgtctactactttagttctcagttcgacatccgatccaatttttaagactatggtaattagtgaaatggggctcacttgttattttatattagcatattaaaattatttattaaaaatgtttttccttttcaattttcaacaaacacttttcaataatatttaatgtctctctatctcgtcttcttgtatacttattcccttcttttttcttatgttgattgattgcttcagtatttttcttcttcttataatttggtgttctttctcgtatatatattatttctcgcttttgatttggttaattattctttgtatcattcccaacacatttgcatcattttcacttcgttttgccctgcttcatcacatgcatgacttatacatggagatttctcctcactttgaggatttcatcattccctttagcgaaaatctctccatccacaccaccgacgatagacaataactccccttaatacaaacttacaacatttattatattacacaatccaaatagtaactattctaaaaacctgtggttttgaatgatttatatattggagaactaaaacaaagagcttctcccacacccttgactactttgacgatctcaaaatccatcatgtattcaacaatgttagagtttaagcgcacaatcttaaaaaatgtaattagcggaagtaaaataaaagagaaaaaacacgagtattttacttggttcactaactaagagaaactttttgttacctacatctaagagcaaataacctggcgtccttttactcacactaaaatatcaagaacagttacaaccgagttcaccttaaagatacatagtcaaatactcaacaagaacataagcctcacgattacaaacaagaaagaaagcaagaaggtttacagggtacaagagataaccactctacaccaatgtcagaatcaaacattacccagctttcagcgttcctctccttcagctcctttcagagaataacctcaagaacccgaagacggaccacacccgagagagagaaccttcacctgcaattcagacaaaaaaatgaacaaaacaaaggacaaagatctatgtactcatcatctttttcgttctacccataaagctcgaggtatcaaccaagaacagtaaaccctaacagaactaggtcacataaccaaagagagaagaagatgatcagagatagcatggaagcttcgagagattgcgagaaataagaagaaaaaagacaaaaaatgaaaagcaaaaacgcttatatattaatgaaggaaagagcaaaatgcaccgtattactaatgggtcaacaaaaatgcttttgcacttcactaactcaacaaagaactttctcttccccaatgatgataattccacctgtaatttttattttgaaattcatttatgttgggcaagcacgtgcaaaaccttatttgattttgggtcacatattcaaatcaaaacatatttatataatttagtaattaaaatattcaaataattttttttatataagctatctgatttcattcgtataattatgctcatatcaataaatagttaatacatacaaaaataataaatagttaatatcagtaaatagttaataattaataattaatatatggtaaaccttgtacctatgatcgagagcatttgaataaaatcaagcattccttgtcggaggaggtgaaagaagaaaaaaattttctgaaaaatcctctactatatttttgttgcacaattttaaatttaaattaaacgggcatgaaagagacaagacacgatcctacgtgtccaaaatcaaagcaaagccaccttagcaaggcacgttgacacggctcctacagtctccattacgatttttctcttttaactttgaagtatttattatttattatttattattacagctcctaaatattttcgcttcgcttgctcggtgtgtcaataggagacgagatctatgcttctcgtctcgtcattgtagacgcacgccagttcaattccactccttcgttttattcgtgtcagaccttcaatttcccgtttcgtttccacgtctctctctctcctcttcgttttgaagagggtccaagtcttctcttccgctgcttccagatctcgcagcgatttggatcctcctcaagctccttctctctcttcactcttccaccctccattgacgaattcaattcgccggttgcagatcccaatcttcgatttccagttccttgatctaagccaccatggcggccgcgaatgctccgatcaccatgaaagaagccctaactgtgagttcttgttctccttcgtttttctattccctcgaactttgttttattcagatcaattcacagttatagctccggaagcaagaactagaacacttgcttgtgatgattattgatgctttgctgtataatcggtcaatttcggtctccaagccaagtatgctgcaattttagtttactagtttgcttactgacaagtatgcgcagatctgattttttttttgttcgctttctgaactggagagtgagaagcataatttttcgttgttgctgatgtattcttttgctagatagagatttgagtgatgtggtttgtgtgatctgtcttgtgattgcagttgccgagcattggcatcaattcgcaattcatcacgttcacgcacgtgacgatggaatcggataagtatatatgtgttcgtgaaaccgctccacagaatagtgtggttatcattgatatgaacatgccaaatcaacctttaaggaggcctatcaccgcggattccgctcttatgaatccgaattctagaattcttgctttgaaaggtacgacgtatttcataacaatattctcctgaatttgtgacttgtgagttgtgttctgttgttactaatattctcgattctttatctggcaccttggtattgatatgaattctgtctttgtggataaaaaatccattggaagctttctttcaacagtttttcttctatttattttttcttcctttagttgtattatttttgttgatgagattgttggatgaaatgaaacaaactgcttaattatgactagtatgacttgaagtatttgaacacgtctagtcatccataacatatctacttctaattccgtggttcttggactgtctctggcacggtcaggtactttatatgcatcctgatcgctagggccacagagctgtgaagcagggaactttgattggtttgagaagctgaaataaactggcatccttattttaaattttatatataatatataatgaagttaaagtatcatgtttttaagtgctataatagtatttgttggaaaaaaaggtattgtacattgctctcactcttccacaagaggatacaaggagggactctattagatgaggaatttatttatgtagatactagaaaaaaaattatgtttaaactagaactttattctggttaattttaataaaaatatatgaacattatccgataaatattttttcttacttttgctaatatatcaataatccccaatttcacattaggcctattagatgttgcagtcctacatatttttcatgctgtcatcgtttgaccaggttttcagtggttaaaagaaaatttttggtattaagatgagctgcaatgttcatagaccataatgctcccagatgttgagcagtcttttaggtttttagtttgttgtgcatgtgcttctgttggtgctgcttttgaaatattgtttacttttggattatcttcacttacaatttacatcattctcttgaagcccaactgcaagggactactcaagatcacctacaaatatttaacattgagatgaaagcaaagatgaaatcatatcagatgcctgagcaggtaactattatgcacaaggacacgtatattgtaacatagtaggtccaatattgtaacatatattgttaatcatgtataggtagtcttttggaagtggattagccccaagatgttgggtctcgtaacattgacctctgtataccattggtcaattgaaggtaagatgatagtttgcttaactaaatttttttgtgttatactatattttccagtttacatattctttatacagtgtgcttgtggtttcagcaaattgttgactggtacatggttcatgatatatataacttgtaggtgactctgaacctgttaagatgtttgagagaacagcaaatttggcaaacaaccagataattaattatcgatgtgaccctacagaaaaatggttggttttgattggcattgctcctggtgcacctgaggtatatttctggttcctattgtagtcattgttatcaatcccaaatagtggtgcagagtggtgaactttaaaaccgatagcgaataacaggatgaccgctattctaaagctatatattcaatttaaataatttacatttcacatttataaatgctcaaaagtaaatttacataaagggaaagatataatcataattaataatacaaaatcagattcttaaactaaacacatagggtcaacaataacaaatgtaaaggaaataaaatatcaaataagtttaagcctccaagtggatgatgccatgattgcttgaaggtgaccaatgaaatgaaaaaaaaaatcataacagaaaacacaaagatagattagaggggtgagcaagtagaagaagaacaaaatgtggacttggaaaacattaaaaaaaaaaagtgagcaaatcggacataggctgacttggttctagttacggattgcttgatgacatgttgaaggcaccattttcagctgtgaaagataaagcaaaggaagacgccacaagggtgatggacagtcctgatatattcgaacgggttcagcctagaacctagagaatactctcacaatacacaagtatttgtcagaaaagttcaaataggtatattccattgcaatttagtgtacatataggcaatcaaccattaattattttaaatgcaccattaactgcaattatgaaggcaagactttaattcctaatggtgcacatgtaaagacataaggctatcagccactaaaataaaaaaataaaataaatacaactttatttaattctaaaatgaaaaatgtcagcaacaacaccctccaacacatgggttttcaataaaaaaaatttatcagcaaaaagtaatatgtattataataattagataagtacaactggtactgttatatttacattgtttccctgtttgtgtatgggtaaagtaatacatgttataataatatgtactataataattagatatgggtcttcaataataatcatgcactgaaataattttggttcaacgtccttcatcgcatgtatagttttaagaattgttgctaccacttgttgtagggtctcctctacctttctggctctggatctagtcataggtcctcctagtccttgtgtcggtccttgagcctcaatgtcctcttagtccttgaagaagctcaaggaccggcacaaggactaagagaacctatgaccagaaccagaaaggcagaggagaccctacaacaagtggtaacaacaatttttgaagttgtacctgcgttgaaggacattgaaccaaaattatttcagtgcatgattattttttaagacccatgagctggagggtgttgttgctgttgctgactttcttctttttaaaattaaataaagttgtaattctttttttattttattttagtggctgttagctttgtgtgtcttttcatgtgcataaagccttatcttcataactgcagttaatggtgcatttagaataattaaaggctggttgcctatatgtacacgaaattgcaatggaatggacatatttgaactttttagacaaatacttatgtattgtgagagtattttctagattccaggctgaatccatttgatcttattagggggctgttcatcacccttgtggcctcttcttttgccttctctttcattgctggaagtgacaccttccacctgtcatccgtaactagaatcatgtcatctggtatagaggcaggcatggcctttcttcactcaatagaacaataacataagaagtggttatccccaggctttgccagaaaggcctgggtttggtcagaaacaacattggtgagcactgagtgttggtggtttgtgtcaaaacaggtgagacaacagtgggtgcttggtgaatcaagcttcaaaaaaggttttgaaccctataagctgttttgatgaaaaggtgggagtgaaatcatgaaagtcactgaaaatattattggagaacttggaaaatggttgccaaaaaaagggtttccctattccagtgtagtggctacaacaactacgaaatgccactcatttgggcattgacacaaatgctttgtgatatctctatagtgctctgctctccactatgtgatactaaaccacaatagcaccactatcgcatgctcatgctcttgacatagttagctctcatgatgcaaatacttttttaaattttcaactttagtttaggcttttcattcaatattaatagttgtctttatctatgtttctgctggatttatctgtgtataattgtataagaattgtgatattttcaacgtgattttaacaaccctgatctattttggtttatttctccatattattttgcattgtagaggccacaattggtgaagggaagcatgcaacttttctcagtggatcaacagcgtagtcaggctcttgaagctcatgctgcatcatttgcccaatttaaagtacgttttttttttttttaattacttttgtcttcattttcccgtaatttttatttattatttcctgaataattgtatatatgctactgtgctggacaggttcctgggaatgaaaacccttctgttttgatttcttttgcctcaaagacacttaatgctggtcaagttatatcgaagttgcatgttattgaactgggagcacaaccaggtctgcatatttttagttcattcgcatttatctgtactgtatctattttatgggcaacttatgttttctagaaaaatctgtcttgcatgctgatttagttatatctctcgacttgatgaattttaattttcctggtaaacaaaaaaagagtaattctactcttctactctaattaacattgaactgagaatataactttcataaactttgatctgtggatgtattactctgatccatgatgaaggaagaggctactcattcttgccaataacttaggtacatgaaatgtattatattttgttgttggccatactatgaggattgttttccatttgttacgatgaccttggacagtttttataaatatatagatgataaacatgtgcaagtgtgaaatttgaaggtagatgaagcagtaaatatttactagataagggtaatattgaaattaaaccgtgtacatcattgtatcacctgtgatgaattgatcatgcttctagagtttgaattgttagagatatcatataaatcattcatgtgtctcttcacctaactgctgaagcttttgagatagttggtatcaaagtctctataactaatggtctagagttctatccttcctgtccccattcttctaagaaaaagttgaacttcagcacaggataggtgggggcctctgttcattatccatgcttcaaggccaaagggctctagcatgaaagggcatgctggaaaccataatatgaaaccactcatgcatcttcacttcacctatcaacttaaccttttgcaatagttgttccttgacaaacattactaatttgttggcagggaggccatcattcacaaagaaacaagctgatcttttcttccccccagattttgctgatgattttccagttgccatgcaggtacagaagttgctagtatttgtgtttcattttataaacagtgtaaatatttgatttctattttgattttttggcagatatcccacaaatacaatttgatttatgtgattacgaaacttggcctactatttgtctatgatttggagacagctactgctgtatataggaacagaatcagtccagatcctatatttttgacctcagaagctacatctgtgggaggcttttatgccatcaacaggagaggccaggttttattggctactgttaatgaacaaaccattgtgaattttgtcagtggccaagtatgttcctgaccttgttataacttttttgttgtaaagtggggtatgaatggcatttttacaaatttcatttgattattatcacagttaaacaatttggagctagcagttagtcttgccaaaagaggaaatcttcccggtgctgagaagctggtatgtcaattttgtgtagaactcaattttagtaataatattttttttcaagggtgttttcagtgagattcaaagaacttggatgcattgtcaattaatctcttgggggcatttgtttcacaaaatgatattgtattcccaggaatgttattcctgggaatacttaaaagtacatttggctagattttaacattcctaggaaaatttttaaaacttaaaataattgaaaataaaaaataagagttggaatggaagttatagttgggttagaaaataacttctcatattcccatgggaaaataaatttcccaccccttatcaataggaatagaaatgacttgaatcatggtataaccactgtctggaatatttttttaaaactcgttacatgggaatactaccttccctagttcacatttccaggaatgagattttaatccgtgaaacaaaaacactcttggggtttcatgtagctgataaatgcttacttgcatgaagttttgatacaaactacaataaaagtgctatattttgatgagtaattgttaactcttctttgtagcagacagccaaacactaattcagtttatttcgttggtgtttgacagacatttcttttccttactgttttttgttgcatatttgttttgaactgtcaacatattattttagagattctattttgtaaaagatttgtgctcaagtctaggcaggtatgtgattgaccttcatgatgcatgctgtagatctgttgcttctttcgtcatttacttcaatgcaatatacactgtttaatctctcttgttattgtatttttggttcttttattcatggatatgatgtccatacttgttgatattacaggtagtggaacgttttcatgaactgtttgcccaaactaaatataaggaagctgcagagcttgcagctgaatctccacaaggaatccttcgaactcctgacacagttgccaaatttcaggtttcttgattagatgttgctatctgagaattttctcttgcttttttagctacttcattcacagagattcattttctggttgtttactgtttgcctttaggtggtgtccttttgtttggtcaattagttgtaatgtttaaaatgccattatctgctttatgtggcagagtgttcctgtgcaagctgggcaaactcctcctctgttgcagtattttggaacacttttaacaaggggaaagctgaatgcctttgaatcattagaattgtcacggttggttgtgaaccagaacaagaaaaatctgttggaaaattggttggcagaggacaagcttgaatgcagtgaggagctaggagatctcgttaaggttgggttgcattaaaatttgaaaaattcaatattattctgttatttataactttgtactctatctttctaattgtctcccaaaaattgcgtaccgattctcatctaacctgtttattgtgaaatgttgtattctattaatttttacaagcatgctcccttgtagactgtggacaatgatcttgctttaaaaatatatatcaaagccagagctactccaaaagttgttgctgcgtttgctgagaagagggagtttgacaaaattctgatttactctaaacaggtgcctgtttacttatcaaagaatattgaagcttaatccatagaattatttaatgctattatggcatgtatagcattatgtcagcctgtataattatcattgcatgtattgccctttcattttactgtaaacatttggtcctgaacattgtattacttatttgttgctataggttgggtacacacctgactacctgttccttctgcaaacaattctccggacagatcctcaggtgtgagagaaacctctgcagttcatataatttttttagttgaacctgaaccatttctttgtagctccccttattgtctgcatccttgttatatctgtggtaactgtttttgttttgaacagtatatgtacattaagttgaaatgtttgcttacagttaccattttcattttgatttgcagggcgctgttaattttgcattaatgatgtctcaaatggagggaggtagcccagttgattacaacacaataactgatctctttcttcaggttggttatatgttgtgattaagcaattatgatgaatattaatatgatatttttgtttcataatcattgatttagtactgaatggttcttgaaattattgttattttccttttggttactttctgctcagagaaatctgatccgagaggcaacagcttttctcctggatgttttaaagccaaatctaccagaacatgggttccttcagacaaaggtgtggcctttgtttctcatctgttatgggcattttactctgaaaattctttctttgaagtgttacgatcttgtgaatcgctgttcaggtgttggagataaatctggtgactttccccaatgttgctgatgcaatattggctaatggcatgttcagccattatgaccgtcctcgtattgcccaactttgtgaaaaagctggcctttatgtgcgagctttgcaagtaaggactctccaaatgtgttttattactttctctatgttaatcttaaagtcaaaccctttgttgattgcattattcttggtgcagcattacacagaattaccagacatcaaacgtgtgattgttaatacacatgcaattgaacctcaggtttatgtgctgttctgcttttaatctcttagagtttaaaaattaaaacccattgtgtgagcttttaaaatacctactcattatgtggttgttacagtcactcgtagagttttttggtacactgtcaaaagaatgggcattagagtgcatgaaagacttactgctggccaatcttaggggcaacctacagatcattgtgcaggtatggtggtgtcattgttttctataacttggaacttatttaattattgttgacaaagctttcttatgtgtgttcaggttgctaaagaatattgtgagcaattgggcgttgatgcctgcataaaactttttgagcaatttaggtcatatgagggactgtactttttccttggatcatacttgagctccaggtaattctttcatttggaaaaaaaaaaaaaacttgtttttctgttggtaattgacctcattttattgagatattgtccaatgtgtttctgctgatgtatgttcctctaaataatatggaacagtgaggatcctgacattcactttaagtacattgaggcagcagcaaagactggtcaaattaaggaggttgagcgtgtgacaagagaatcaaatttctatgatgctgagaaaaccaaaaactttctgatggaggctaagcttccagatgcacggcctttgattaatgtttgcgatcgttttggatttgttccagatctaacacactatctatacacaaacaacatggttcgctacattgaaggctatgttcagaaggtataatagtagccttacttatctcgtgagtgctatctactctttttctctgcctttgtaaaactttgtgcctttctatacaggtgaacccagggaatgcacctttagttgttgggcagctgctagatgatgaatgcgcagaagattttatcaaaggcttgatcctttctgttcgttcattactgccagtggagccccttgtggaggaatgtgagaagaggtggtgtttgccctttgattctatgtgttattgctttgcattcgtgtttcttattttatcctgtggcttttttatatgcaggaatcgacttcgtatgctcacacagttcttggaacatcttgtaagtgagggaagccaggatgtacacgttcacaatgcactgggtaaaattatcattgatagcaacaacaacccagaacatttcctcacaaccaacccatactatgattctcgagttgtgggcaagtattgtgagaaacgtgatcccaccttagcagttgtagcttatcggcgaggacaatgtgacgatgaacttatcaatgtcaccaacaaaaattctttgttcaaactgcaagcaaggtttgtggtgtgtattggctcctctaaagtgagagagtatactttgccggataaaagtgtagttgcaaccattgattagaaaaccagcagttaaaattgttacaactttgaagtttgttgtacttgtattttatcatattctcaaccgttgattttctaatcaatggttataactgcacctccgtcactttagaggagctatatttgtggtccttaatctaccaaatcaattttatttaatacaatgttcacatgcttatattgtgatgacagatatgttgttgagagaatggatggtgatttgtgggctaaagttcttgatcctgataatgaatatagaaggcaacttattgatcaggttgtatctactgctttgcctgaaagctcaagccctgagcaagtttctgcagctgttaaggctttcatgacagccgatctgcctcatgaattgattgaacttcttgagaagattgtgcttcagaattctgcattcagtggaaactttaatttgcagaatcttcttattttgacagcaataaaggctgatccatccagagttatggattatgttaatagattggataattttgatgggcccgcggttggagaaatggctgtggaagctcagttatatgaggaagcatttgccatttttaagaagttcaacttgaatgttcaagcagtcaatgtgttgcttgataatattcatagcattgatagagctgttgagtttgctttccgagttgatgaagatgctgtttggagtcaggtggccaaggctcaactcagggatgggctagtaagtgatgcaattgagtcatttatacgagcggatgacgctacacaatttttagatgttatccgtgctgctgaagatggcaatgtttaccatgacttggtgaaatacttgctaatggtaagagggaaagcaaaagaacccaaggtcgacagtgagctcatttatgcatatgcaaaaattgataggctgagtgacattgaggagttcattcttatgccaaatgttgctaatcttcaaaatgttggtgaccggttgtacgatgaagcattatatgaagctgcaaaaatcatatttgcttttatatctaactgggccaagttggctatcacactggtcaaattacaacagtttcaaggtgctgttgatgcagcaaggaaagctaacagctcaaagacatggaaggaagtttgctttgcttgtgttgatgcagaggagtttcgtttggcccaaatttgtggactcaacattattattcaggtaatgtgttgatttcagttttttgatgaactgtgtgcgcgcgtgcgtgtgtgtatatatatatatatatatatagaaatgtttttcttaatttctgatgcagaccgagttcaatttagagagtttaagtgatctgggttttcagtatgtgatggtgaagcaatttccctaaaagtatgctgtgaaagcgtgaatgcgcatgatttatgattggaagggtgttgtgcttgttatatgaacttaatgttgatttgctggtagtgatctttttgaatttctaatgcttattgcgtcattttttttttaattaatttcataggtggatgacttggaagaagtcagtgaatattaccaaaacagaggttgcttcaatgagctcatatctctcatggagagtggtttagggttagaacgggcacatatgggcatctttactgagttaggagttctgtacgctagataccgccctgagaagcttatggagcatatcaaactattctcaacccgcctcaatattcctaaactcatacgagcttgtgatgaacaacagcattggaaagaattgacctatttgtatatacaatatgatgagtttgataatgctgcaactaccatcatgaaccattcacctgaagcatgggatcacatgcaattcaaagatgttgttgttaaagttgctaatgtggagttgtattacaaggctgttcatttctacttggaagagcatccagatcttatcaatgatgttctgaacgtccttgcacttcgtgtggaccatgcacgtgttgttgacatcatgcggaaggtgggatcaatattggcaaaattttcattagatattagttgttgcattgcatgccataacactaatgggaaatttcactttgatatgctataggctggtcacctccgtcttgtgaaaccgtatatggttgcagttcaaagcaacaatgtatctgctgttaatgaagcgttgaatgagatatatgttgaggaggaagattatgatagattgcgcgagtcaattgatttgcacgataactttgatcaaataggccttgctcaaaaggtgtggaaatttgctcttaattggaactattttttggtttcagttgtggaaatctcagattattgttgttactgtatgatgcagattgaaaagcacgagcttcttgagatgagacgtgttgctgcttatatttacaagaaggcaggtaggtggaagcagtctattgctttgtcaaagaaggataacctttacaaagatgccatggagacagcctcccaatctggcgagcgtgaacttgctgaggagttgcttgtttatttcattgatcaggtgctaaattcagtttcaaacttcatatataattcattttcttgcaatatcttatttgattaggtttactgttattcttggatatgttttgtttaattgttataatgtcatcctttgtacatgtctatgcgtacatagctactctgcaaccttctttgcagcaatggttattgcatactagtgggacctcttataatatgtgtaatttgaagtcatacacaaattatttgattccagagttattagtattttctttttgccaaagcctagtggctgttctgcaatagcatgccagtcttacaatcaaaactactgattgaaggattgtcattcaagcttcttacccaagggttcaagctttttagtttgtccttatggggtgatagtatttcaatttatttatatgcatataattgagatttctaaagtttcttttcatatgcttatgcagggaaagaaggaatgctttgcctcatgtctatttgtttgctatgatctgatacgggcagacattgttcttgaactagcttggatgcacaatatgattgactttgccttcccatatctattgcaggtttgcatttgttttatgctgctaatttgtatcacctgtagttataattttatgtttcatgattcaatgtgattcagctagctattgatttgtatcataagatttgatcatataatttgcaaagtctgatagtttatgatgggttgcaattttagtcagtccatttgaactgcttttttggtgaaacagtttaatcttcctctttacttataagatcaacttatttgtaaacacttgttcattaagtacttgattaaacagtttacccaaatgcacaattagtggtgcttagcttgtgaatattgtgattggtcttatgtacttccggtattacagaggttatgtgagcaagcaaatctaggttgactattgcagttattgtcttctcctgccttccattgagctgaaatgaatctatttattgccatcttatccagaggtttctctcatcatcaacttttttgctgttgtagtttattcgtgagtacactggcaaagtcgatgaactagtgaaggacaaaattgaagcacaaaatgaagtgaaggctaaagagcaagaagaaaaggatgtagttgcacaacaggtaattattttatgccatgctgtcactctgtcagcagtttgagtgttcagaaatgtttgctgttgataaatcctcatctttcgcattcttcatcctcgactttctcaacagattgaacattagagtagtgctgatatgaatgagatgtgctttttgttgcagaacatgtatgctcaattgttacctcttgctttgcctgcaccaccaatgcctggaatgggaggcccaggaggtatgggaggaggctttgctcctccccctccaatgggtggactggggatgcccccaatgccgccttatggcatgccacccatgggcagcagtttttgaagagtatagcatgaactcggcccctatgaagagcaatgtaggaacttcgaagttttgcgtagaagaatatcttgtgtgatttggatgcagcattctttctttgcttcgggtggcggtgggagatcccaagttaaaataatgtgaagtttttcggtttagattgtgtcataatagtcttgtaagtttattgttctttctgtgttgtagtcgaggcattttttgggctgctgattctagctaaccgataaatttctgtattctaccatttttcttgtattaaaccagttagtcctaggtaaaccaaacaaaaaatgaattacatctagtatatataagaaatttaccgactttaacagccagctttatatgtgcatgttgtggcctaaatttcctcacattttcttgatatggaagctaccggattatggaggcacccttgttaccccctgtttctgcagatccacgctacacccttggagacatgtttagagaaaaaccacattcatattagtgttccttgaaaaaccacaaacttatatatgcagctatattttgcttttagttctattaactcaatctcaacacttatttgaaagcgtcgcgatagctgacttgggttccaaatggcgctacatttggaatctaaacatacacgtggtttttttttgcaaatagggttaataaagcatggtagttgtttggtttgctactatttgattagatataaataatatacttttaatcttgagaatcctaattttgaatgtgtttttgagttggttaaattagacaagaacatagttatccaaagcatgaagaatttctcttttttctttctatgaatggtcaataaattccgtggaatgttggaagtggttgtagggttcaaagcataacatatttgaaaaatactatgtgcgtgcagtaatggcactgcagtgagatcagtcggttattgactagtagtcagactttgtaacttgtataagcgctgaactgctggagtatgagggtatcccccattcccttgtaccttcttttataagatatactgttcttggctcaaataaaaaacaatacacatgtatcgttctcaataataattagtgttgctgcatatacaagttttttttttttttttccgcaagaaaaatagtcattgtgatgagccttaacttagactattatttttaagaacaattcaagttaacatttttatgtatctctgttcctaaacaattactaaagtcaatttcattgttaagaatgtgcaaaaattagtttggtacaaaaattaaattgaatttaatcattttaataggttcggttcttaaatccaaattaacaaaatgttttatcaaactagttcgaaattgatttgattttaaagaaccggttcaaaatcaaaccgattttgaactaggaaattagttcatcgtgactgatgtgatacaatgagaaaatcaaaataaaaaaaaaaattcaattataaacgcatcaaatctctttatagtaacaattactctccattgagccatttattacgaatctatgcttgcaccttatctttacactatttaacctttctttgaccaaagagacaaggaggagtgcataggcctcctaccttaattagcttcagtgtttataacgctttatttcttatcattccctttcttgataaaaaaatcaaagatttttatttgagtttaattcattgatcttaaatttgagttagttgtattttatatttggagagaaagttgtcactcataataattttatttgtctcccacatgatttctcttaggaataacaatggataggatcctaaagcactcattttcatatccacatttaaaaattatacttgtattcggcctcatacccatatgggtaataattttaatcttcatctcggtattatatattcatatctgcacacgtgacccacaatttacttatgtatagggttaataataataaatcaataaaaatagtttaattaaaacaagtcaacataacattggtttgtctaaactcaagtcataaataaataaaatttaaaaaataattatccaatataccaattgttaaagttaatgttataattgtctaacaaaaactctaattaaaaatttaatatttttcactctttgagaatgatatttgttagagattaaagacttagaatattagtaaaagaaatataattatttttcacaattatatatatacattactattttgtaatatattatattattaaatatatacatatagatgacatatcataagagaaatatatcttaaacaatgagaggattgaatttagaccatataattaaacatggccagtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaaaacaaaaaaaaaaagacatgccatctcactttgattgttttggtttgccacattttcaccgtgatgccttcactttgccgatgatatatagataaatattgaagatatgttttgagattatgggacccaaaagcctaaaatttcgatcagatattataacatgggttgagggaaagaaagaagaagaaagaaacaaggaaagagattgaagaaaaaaaatacggaatcacaagaaaccacacaatttgaatgagagataattgagcctaacaaagtgagtgattggatcagtagtcgtgtcactctttaaggtgctttattatgagttacaaattgagggaaaatgggaccctccagtgattgtaattgaagcttcctttgtttgctagcttgtgctgtagacagactaagtgagcttttcaatcagagcgccattaaagtgtacaaaataagccgcttttactcagtggcctgctttcaaattccacctttcaatcaagatacatgaggaattcaccaggaaataataatttgaaagaaatcaaagtaattaacctctcttccagatgcatgcacaattggacaaacccacttatttgtccaatatatatagagattggtagtaaatgtagtaattgtaacaggatagaattgcttgcgattcgtgtggtgcagtaatcccctaagtctctgctaacaatttcgacatatcattgatgtcttgtctggtagtacaaaatgtttcctttctattacttttaatcacaaaataatatagagatgggtaaaataggtccacaacataagttgtcttaaacttaatggacaatccgtttatcactgttgttacatcaggcatttgtctaattgtacgaacaaatcttgcattttttttttttttttttttgtgtacaaatgttctctttcagtcacctttttcatcttcctcatcatggcaaagactaaaacctcggttgggacagtatataatagtacagcaacttatgtggtgaaacttaaccatattgaagttcaatgtggaagcccttgatatagtatatctttgaatatatttcatgtgtagcccatatcctaggttaaggctttaaaataaaggagcatttttatttttaactgcaaaggtgcatgtaggttttaaatgtcagtcgagttgtgggtcacaatctttgacattatgaaaaattacagacaaatgcaacgacaattgcggccacgatacaattgtcgtgagttcaacaccagaggttaatattgcgatctcaaaccattttttaaaactgtatgtttaatcttatgaagtcaaatttcaagataagtactactagatctggactataatccacatggtgagcccaaatggttatgattgccatcagagcagacaaaaaactttatggctatacacacatatagaagaataagatactgttcgtgcatccactacatcaattgctcttactaggtcaagcgattccaaagttccacacagtggttcccaagtccatttgcaagatactatttcatttatggttcaaattcttagtcagcacggatactcactcattaagataagcctgtttgttgggccaggccacaccctcttgctttttattttggctcttcctttttctccttcttaaacttgagagattctttacaaagtctagtgagatttattagggaggcaaaaaaaaaaaaaaagattcttggtgaagtgacagtaggatacagccaaaaatgattttcatctgaccccattaaaggtcattgcatatcacaccaatcaccataaaagataagaagatcgcccattaagcaaacagtgtccatgaaatgggaaataaaaagctcacaaagcaagacacaagcattagaatggtttgtaatttgtgttgtgtgtgcatatggaaagttactactattctggctggcctctggctcaatgcaactctgcaccaaacagtgatcaattatctcctttttcagtcccaacaacaacacaacaaacactccctcttgttgctacttcaacttctgaccctgcagcagcagcctctcttcaatttggtgagttcccttcgtggcctgcgcccattgcagcagaagatagagctgcaagtgcttccaagagccacagccaagcagagaaaaggcgcagggacaggattaatgcacagcttgcaactctcagaaaactcattcccatgtctgataaggtaaaagggaaaaaaaaatcatgacgtgtttcttttaataagtggcatagttactcctatcaagtttactattttttaaatcttgcataatgttttagacaataagcaagaaagtggaattggtgaattacgtattctatgatgtatagggtatcatttaaggtaaattaaattagattcgatgtaacaatacattatgatatgatttgataaataattgctttactttagcatgtgatcaatgtgatcagggtctgatcctcaggtccacgcatatagaataacatttgataggacttggaagagactaattccttaaatacattttaatatttcggagggattaattttgactgtcagccaaaaataccttgggttaaaaaaagaaaataagatttgatccagtgtaaatttgtggcatttcaatgtttcttttttcatgatagatagcatagtcactttcaattccatgaataggtttactaggttgtatgataggccatatagatttcaattccactaacttgcccatctttagtaaaaaaagaagctatgagaaaaagaattatagcatgaatagctttacgataggttgtatgataggccatatatttcagttccactaactcccctatctttaatagagaaagaaactataaggggtaaatttatgtggttgcagatggacaaagcagcattactagggagtgtggtagaccatgtgaaagatctaaagcgaaaagccatggatgtcagcaaagtcattactgttccaactgaaactgatgaagtaacaattgactaccaccaagctccagatgaaagctacacaaaaaaagtgaacatattaaaggaaaacatcataatcaaagcttctgtttgctgtgatgatcgaccagaactgttccctgagctcatccaagtcctcaaagggttgagacttacagcagttaaagctgacatagccagtgttggtggcagaatcaaaagcatattggttctttgctcaaaggatagtgaagagaataatagtgtttgccttagcactctcaaacaatcacttaaatccgctgtgaacaaaattgcttcgttatccgtggcaacaaattgtcccactagaagtaagaggcagaggttcttcttgccttctcattacgtacaataattcattgcaattttctttttcatttttgtttttaattcttagaggggtcgtgtcagtagctcaaattattggttccatttttcaacatttatttaccggtcagatataaaactaaggaaagcgtaagtgttaattttgtgcctccaattatggtaggttacactgaaattaaaaagtagccggttaagcatattcaaagaccacttgttatgttacgtccaaaatagaaacatgagcttaattaccaatttatgcaagaaaatggagggggattgagagaaaatcttggtaactttcttcatttggattttatccaattagaaggataattggaaaaagaagaatcatgaacaataaacaattacattgatatacacatttaaacaacggaaaaatatacttttcaaagcaaaaatattaagtaactatactgtagctttcatcagaaagtccgtcgaattcaattacttctcaaaaacacactacatcctccaacagaattaacttaaggtgacccagtaaagtaaacaataattattaggataaattttaatgttatcttaaaatctatattatggcttaactcaacttaaaacaacattacttgaaaattattcttcacttatacgtactatttaaattatttaattagtgaacgcgagatttacaacaatactttattcttatttttttttatggtagatactttattcttaaatcatactacatgtgacttttagaaatgatttatggtgttgggaaatattgacacgtctagtcgagtaatcttcaatgtagtgcaacaagtcgttcctgtatggggcccaatattctctggttatttatacgcagaagcagcagatgatttatgagatgcaacaatcagtgataccattgtagataagaaccacgggcattattagattactataaaacaaaaggaacattatagaaaatgttcctttgaaaatgatttataaggggaaaaaggcaatcccctgttgcaatatgtgtttctttctctttttgtttttagaattgttttcttttttagaattgctttttatttctcctgaatttttatatgcgacggatttttaaccttcaatatcatttttgaataaaagattttgatcaataaattaaattcttaaaaaattatgaatacgaatttagtacttattctatatatttaagagactatcttaataataaataaaaaaattaactattaattaatgtgatggtgctttacttttaagaaaactaatttgatgataaaagtattttaaaattttgtttgagaaaactagctgaaaaattaattaaaagttaaaaagctatttggttgttgaaagttaaaaaaataatttattaaattataagtgtatgataaaattaattgttgaagtagttaaaaaatttaacatgataataaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcatttatttttctcctaccaaaaacctaaaaaatcatcttactttcaatttttttatctcttttcatttatttattttcattttctttccttttacttttttctcaaaatcgaacacattctaaaggatatcatcacctaatatgatcacaatttgtaaagctttttggggctttctgaacaatgtagggactatttagagacaaattactcaattaggatacttaaaaaaatgaatttttgacttggactggttttcgttatatgaaaatccactttattagtaattatcttgaatattgcacgaatatattttagatatttgaaaaataaaatagttaaactcatagtaggaaatttgaataatatgcataagattccaagttcaaatattatcgttattattatataacaaaaaaaagtttaaatttaaagaaaaatgtgtgtaactaatttaaataaataagtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctatacatttttttttttttcagaacgaatagacatttaatttatttatattaaagtcaaaagtattaattttcaataagttattcaatcaattcatactgaaaattaaaatcaattacagtaaaaggtttataattaattaatttaaaatagatctatatattatttcaaaatatcattgaggtaaacttaaaaatgataactgcaatctttcaagtttgtaagtcaatttataacacaacaaattatacttaagccaaacttggtgagttcaagtcaaactttgtaactttaaattttatttaaaataatggtacaaacagtatatatattttgttaacaatataaagaagaaaataataatattatagatgctgttaggattcaagaaagtcacagttacaccaagggactttcaagccaagaggaagacaaattttaaagaaaaaggtcaagatgaaagtggaggggaggatgcacatcaaaagtaaatgaagatgtggaggtggtactaaatgaggaagaggagaaaagctcatgatatacaaggatagattccccaatcatggggaggacactatttagttgaggaaggaaatggatgatactcctaatgaagaaatgctataaaaaaaaatatgatataaggaggtaaaaaaggacggaactgtaaagccttatgttccaagtctagagatgccccttatagataacgaataagagagttggacagagtcatcgaagaaaacaatggcgataaagaattgggcaagaaggtgaattttagggttcatgaaaacaaacttcaaagaagctagaccaagggggtatgatatcgatatgtagatgtgccaaatgaatttaccttgtaaaattctttctcatcagaggagtatcaccatgtgttatgtgtgaaacaccttaggggtattaccttaagcatatcaaagaatgagtaaactatcatatataattataattatcatctgttaagaattccatgagataagtcatgcattatttttaagtaatgctatcatatacatgacataaggggtctctatacaaccgactaagttgtcttttattgaaatttgttataataaataaaagtgtcattcaaaatagaaataaaattaaatgaaggatgttttaagaatattaacattaaataggataaaattaattaaatttatttatatgtaagtacaacaaaaaatatcatttttttagagttccgaagagtagtttatataaaactttgcttaatcgttccacataaatataaaacattaacttttttgcatgcttagcatttattttttcttcttttctttctcacaataaagtattgaactaattaattcttcaaagagagttcttcttgtctatgtgatgatctcggacttctataccccgtccaagaggtgtctaccactttttggagataagtgatgaaactttgtccaataccaaaaaaggcaccttaagttagtattcggaaaggttgttaattgtttattctccttcctccaccaaaggaaactcctcaacattcatatacatacatagacaataattcattggttaaaatatcataagaatgactaaaaagatgatgaaaatgtaggttgttacaacggcctcacgcttagggtaaacatatatggccgcttttagcatgttagaccctggaacttagcgcgcataagtggcttttagtcattgtcacaattataaaaaaacaatttatggaaattgttcttaaggttcaagacaactttggattagaatgagaaatctttccttctcatggaatttttcgcgagtttagttaatttttatctattagtgtaaaaacttattggaaactatataaatataacttttaaaataattcttacagaagtccataatcatattatataaaaaaaattataaagaccacattgttaattgacaccgaaagagaaaaagaaagaaaaaaaaggtaataataaagtctttgacatataataacctttatatctgaattaaaacaaaacctttatatataccatcctttgttatcatatatgacaatcgataacaaaatagatgtataataaacttggatatattctaattaaatatatttttaactagtataagaggacaaccaattattggcgttggtgaagaattgaatcgagttatttaaagtttgaaaactcctccaaactcgagcatgtaccatatgcatgtctaactgcactaacaacttacagttgcaaaaaaaaaaaccctctttggtccttccatttactcatccaattcccatcccatcgtccaactacatataaccactcttaaatatattataaccgatggcagttacaccttcatgttcattttgacttcccatcagttagttggcctccctggctacatcaagattatgataataaataacaattaattcccgttataaaacaaataaataaaaagtcaaaaattacatttatagactgaatactccatcctaactgccacactcttggaaatcatcatgtctatccaactaaagttaaagtttaaaacaacacacattttaaattaatggaactaaccgtgagacgttataaaataatgacaaaagaatcagaacaggaacacgatcaaaatttatccttatccaccttccttgctagagtttctaggaaaaggcgttatttgaatccgttagataaaagaggaagttataacttcctccattattaattaatcttttctcacccactctcttcataaaccctcaattctctcaagaagttagaaaaccgacctctgaacttccacctacctaagtccaaaccataaacacccacacaccaaaaggttgtggaacagattggaaccagaaaccttcccgcatttgttatgttcaaaaatctgttatacttttaagtttttaaggttcgtgccaactaaatcctttttcattcatttatgatctaaacaagaaagcagatcgcataaaaacgtatatttaacaggcaccaacctttgtgtgttttctctggcattttctcgaacaggtgaaaggcgactacgatgatgaccggcggcgacgaccgcgtgaagggttcttggagtccacaggaggatgcgacgttgctgaaactggtgaacgagcacggggcacgcaactggtccgtcataagcgccggcattcccggccgttccggaaagtcgtgtcgtctgcggtggtgcaaccagctgagtccggaagtgcaacaccgtccgttcactccggcggaggacaagctgatcattaaggcgcactccattcacggaaacaagtgggccaccatctcgcgcctcctccccggccgcaccgacaacgccatcaagaaccactggaactccacgctccgccgccgtcgcgcggaggagcaatcctcctcctcgtcagcgtctccgcaggccaaacgtccctcatccttgtttgacacgtttcagcctctcaaaaagcagtgcattgaaaaggaaaatgaggaagagcgagcgccgagtcccgttacgacgtcgttgagccttttccctcctggggaaaaatcagaggaagaagaggaagaggagaaagaagagtttgttaatcacaaggttttggatcagaattactttatgcaaatgatgcagcggatgatagcggaagaagttaggaattacatggagactttgcgcaattgctaaagggatggtctctcccttgagcctggattagatcttcttcctccgacgcttccaaagtaaatgattctattttccattttttttcttcttcttttcgggggtttcttactgtttttggagttattctccctatgataacagtcttaataattcgttagtaacactcaatgtactcggtttaagatgaggttgatgaataattagtcagtaatacgtgaaatttttttgaaacatatgcaaaactataaacattcatatcaatttgaggtggattttgagaggaaacggagataaaaagtatatatatatatatatatatagatagatagatacttagagaatcacatgtgataaagtgacaagtttttttcaattaaatcatctctgacgaggaagatgactgtcacaacctcatcaacaacaaccaccacaagccaccttctttgcctgttattgttgttttccgtgtttgaaatgtttgagaatgtccatgaatttgaaaggtaggagatacaacggcacatggtgggaatgttggagtcgtcgaaaggaacgtggccgtcaaaggaggtgaaggcaagcgtaccgccgaagtggagaggctacaaattttggttgagaatcaaaattcgatttatattcattttcattttcatatgtatgtttatattcattttatatgtatacgttagaacataagatgagttaatatatatatatatatatatatatatatatatatatatgatagaaaatgtgaatgaaattctgaatgaaaatgtgaaattgtgaataaattgtatgaatgaaaaattgaagaagagaagaagaaatgattcaggttcaacaaaaagttatattcacatccaattacataaaaaataaaaagggagagattttttgtaggatgtaaaaaaaagaatatcaaataaaatttaatcaaaatacataggatatgattatattttgcccaaaaaaataaaacaaaaaataagataaaaaatttatttagtctaagttatataataatagagtaatgctatataagtatttctactaataaacattaagaatatcaaagaagagtattcttagaattcttcattcatcaattcatattataggaatacaatgagattttttttcttctttttagttataaaaaacatagatcactttttaaatatattaaatatttttgtatagtcttaattattgtgaaatcaattaaagagatctttatttttttatgaaaatatttatttattagactattaacaatataaaaacatccgttggtcaaaatcatatatttacataaatatttatttggatataagtcaaaatgattttgagcagcttactccatgttttattaggaaaggaaaagattaaattattttagactaactctctatagtttaattaattttttaatcaataccttataatttaatttatttttaactaaagcttaaatgccggtatgttcattaaacgttactgagttaacattttttagacggaattaacgtataattatcaatgttaggcttctcaactaaatatttacataaccatcgcatggttcgcctcaaatttatcctggtcctaaatttactaagtgatgacagcattaaaatatcctatattgacttgtatcctttatggtatatcaggatgaaacaaaagaaattaaagagaaaaaaaatacagaacatggtatgtttttgttttgttaagttagggataaaaaaaattttaatctatagaaattgaagacaagagtttacaatattttgtgcaacattttcaatcaattgaattagaccttttaatagttggagagaataaaaaagagagaatagagtgaataagagagaaacaaagaaagttaatttttacaaacaaaaaattaaatgattttttactacttttctttcaattcaaattttaaatttcatttcttagtttttcgctgtgactcgaaactgaccattagttaataatcacatgaaattttgactacattctttataaaccctccaatgctaagaaaattgatttctactttaacatttagaaattagaattatgaatagaaattaattagggtttttgtggataaccttgttctcacctgcaattattttccttaaagagactgttctaggaggaatattaagagcctaagacggctgtggataaaaaaccaaaccagacttcttattaaatgttggtcaaatgataagtttttttttaaagttaaagcaataatttaacaagcgtgtaataatggagtttagaaataagggtaaattgaaaagtaaggagtaggaattcaaatagaattgcaaaaaataagagcctaatttgtgttgtctaaaaaaccaaaggaatacaccatctctatttctgactcagaggtgacctttgttcgaatgtataaatattgctttctaaaaaatgttacaatagaaataaaagtgagttaaatacttaaattacaaatttctatgtgaatataatttttgtatttctcatccacattatcatcaatgacactccatgatattttttttttatattgcataaatttctcctttttaatatttacaacaacttttattatgcacaaacataatttgaagttagtgttaaaattcacaaatataaatctaggtggtaaaattagtaaattaaaaataatttgatgtaaattttataattaaaaaaaacaacataagaattgccgtgtgaatgcacatcgcaagttcttattagggagggaggttgctataataatggtgataaaagtaaagaaagtttctacaatctcaaaacatcatgcgataatttagtgattatttaataagtgttaacaaaatcaattttaaactctactttaacataaaaatgtaaaaaattatcaaaaatcaattatgaactcaatcaattctcctctaatataataccaaatgcaaaaatttatcaaaaatcaattattaacttgaaatcaattctttaacctgaaatcaatcttacacttaaaacgtgtcttcaaacccaatttgcaaaagtattccttacaagcaaaattttggtttcaaatatatttttgaaagtaaccaaatatgattttgaattcattttactcttaatcatacttttgaaaaatcccaaaaaaaatccaaacacatccttactctattcttaaaaagtgtgttgatgaacaacgggaaaaatttctcccgggatattgcccggctttagagccaatattagattcttcagtctttttactacctaactaaaccacaaattttgtaggccacatttatagaaaaagcagtttttgagcagacactcacttgctccttcttttaaagatttgtactggtgggattttaaacagcattttgttgcagaatatagattctcatagtcctcttttcatgttatttgtgcttacctttatcttcttttcgacatatagcataatgaggttttgcaaaccttggttgcaaactcaaaacattcatttaatcctagaatgatccctttaaacctatagcaaatttaaaatatcatactgatttgattgacaaaaacataaaaaactacttttcgcaaatttttctttctaaaaatattcatataatctaatacataacctaatgacaatcaatcatcctaacgaatcaaatctgttttggtcatttcagatggcgcacagaattaaactaggggatatgagaaattcacctctctgcagggatgagttgttcgaatggaacgctgacaatacttgaatcccatattgtaattcgcaatgatgagcattgccgtgcctagttatttatctatattatttggtgaaacactaaatttatgttttctttaaaattgacttcaacaaaaaaactgaaatcatcactggctttaattcctaatttctcagcgatatgtatcaatcaacaagcttttatgggtcagcatatcatgtacccgatcatatttcataaatggtgtttaacaaatactaaagagtaatgagataagattccaagtggcaatgcagcaacaatttttgagaaaatgttaaacaaataccatccaaatcatcctaagtaattgaaattttctttatcaacaaaacaattgaacggattaagccttcagatctaaatttgggggatacgattttggaataaagaatatcaattagatcataaaaaatttgaagcagatataatgtgaaattataataaccctaagagaatcagagatgcaaataagagatcatgttgattagcaaaagcagtaacaacattgttttgagctaataacataagacgaacataaattacttgaatccaacaaaatgtatcaaatatcaaaaaggagaaaccagtgccactaacaactgggtgtcccattcgacaacataagcaattgtaaaaacaacagaaacaaactaggtttaacgcactacttggatctctgtctcatctttcggcgcttcctcttcaacctcctcatacgcttcttcttccactgcaaaaaaaacaaaaagtcccaatcagacctcaacgcttaataaaaacacaaataggcaaaggaaatgagcgaaacaacagtgaacaattgaactcaccttggctctcatcgcgaacagaacaccaaaccctttttcgtttctgaaccctagccgaagctgctgagaagtaacagacgattaagaagaaatggaatgtgaaggttgcaacaatttatagcctacgagaaaccctagcaaattatgaggaagttttgggctctaacccaaaggcccagcctgtacgagtaatgagtcaataggcttaggaatgcctcaacaattagaatggcccgttaggtttgtgtttggagtgaagcacatgtgaaatgtatacagttttagtttacttctagaccagtaaaaaagttttctttttcttcttttaagtttatactgaaatagattatttatcgaataaatgaaattcattttaaaaaaatgaatttaattcaataaattaaagtcaaaacattaaaaaaaatgaaaaatatgttctcgtatcatatttgtttgtttggttggttactggttagtaacatggaaggaaggataaaattcctgcggaacccatattttgttttgctttcttcctcatttgagaagaaaaggatagaaatgtcttattcatttaaaaaactaaatttttcttaattttatatacttcttttttttagtatgaatatttgtgtcattttgtgtttttctttcctttcattttttcttcttacagcaaacaaagcattagagtaggatacatcttaaaaaataatttgtctataattgggcagaaaaggagagagcatatatatagaaagaaaccaatttttttatatatatatatatataatgttagtttggtgattaaacgaagaagaagggaaaagtgattctttccattaatattttaacaaaattaaccgttagtattatctattaaatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagaatgaattgaaatgaaatagaataaaaatatcacgtcagtatctgaaagttttacaatggcatgaagcagaactttcatttagtcgatttaaaaaatgagatgaaacgaattataacattttaattagtatattttttttgtgaaaacattttaattattatattattcttctttttaattatttttttactgcatttgatttattttatatattcaaaaatacttttaagaaaacaaccttaaagcatatatattttaaaacaaaaaaatatatttacaaccaagaaaataacattttgtaagaaaataattatttctctaataaatatcctttatattttataagaaaataaagttttgcctgaagaaatagcattgtataagatagtttgctgtgaatttatctttaattaaaataatttttaaatactattagagctgccatatagcaccaaattattttgcttaaattcacatctaaaatcaagtatttaaacacacaattaagttgttgttgtggctgtctttgcgtagtggtaccgtattttggatagacattttagggatgtaagattgagtaaaaaattcacaaagggggagaacataacaagaagtcaagaagggcacacaactattagacgatatgtttgtagaaattaataaactagaacaagcaagaacttcaacaacaaagcaagggcctgtcccaataataattgacagtaaattaaagaggcttattggcggcgaagttaatagtactaaaatagtattttcacaatttatagtaactttttgcttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttcaaagactaaaacctgacagctatatttgcagagaattaaaatatatttaaggtttttatttcttactttattaggacataaagatgtatcctcatggttccatcgtgcgaaatcttatcggattaagcaacaatgtttttcttttggttagtccttaaattccacaactagtttcatttaaagtttgaaatattcctaatttgagcgaaaaaattgtccctaatctttttttatattaagatattatatttttaaaattttagtaaattaaattttatcctttttatttatagaacttttattcaaattaaacttattatatactacttctttgtgtttgatgtcctaaaacattttatctctgtactttaacttcctaaaattaaaaagaaaaaagacttcaaattccgtttgaaaactgctaacttagcatgaaacacgcattgtaaacgtaatccaattggtgggaacttgcgattggagaaaacatatataaaaatcaaaacaaaagtcttgacataaagtcacatggatcaacaatggagtgaactaattgaaaatgagaagaataattataaattttcatactctatcatcttacaaattattctatttttttatatttcgaaaatattaaatatttttacttctccttcaatcctttgaagaaaaagaactaactaaagaccatatcttacttcaaaaaaatgatgaagaaaaaagggatatccttttttaaaatgttttcattagcaatgtttttgaagaagaaaaagaattggaacctttgctccatcataaaaatgagtagttataaaaaaatacatattttattacaaaactttcatgacttacaaatggaaattgaggtggttcaaaaagatttaaaagtgatcaacgaattacaagagatcataaaagataataataagatatttaggaggataaaataagagaatataacgttctcaaatggaaaaaaaaaggatgaggggtcgtagcatagtcgtactttttcatgtttcggggtcccaacttaacaaaaagtccccattatctagttgcacaatataaacagaacatataagagcaatattattttaggacttacatagatgaggggtgcaaggaaattatattcttacctttttgaaccccggtcttgtacttttccatcacccaacgtgggaacaaaactcaatcagaaaataaaaaataaataaaaaaacccctgtcttggacctttgtcacatgtgaaggaatttcttgggtaaccctttttctttggctttggcaattggcatcttccaacttattatcaatatttaattaattctgaataaatatttaaactccggcaaatgcgactaataatttatcacaacattccaaattaaaaaaatacaacaaaacatttaaaatagctaaccataccttttttctgtattttaatgttcaaatggtaaattagactcaattattttgattccacttagactaaaataaaataataaatttcgttgatgttctttattctcaaaattaagtgcctctttacctgaatcagaaaactacttttgagggtaaacctaggtacttatctcctaattcaaagtcagtgactaatttttaaattattaaaatctatttacaaaattgatatctcattaattcatatatttagatattaaacagcggtgattttaatgaatagatctagatttagatggttatcgatatcgaaaatataaaaaattatataaagttgatatgttgctagaggtaagaaaattcaaactaatataattcgatgcacattacagagacctttaattcaaaactcagcccacatatataagagatatactagttacttatccaacgtatcaaaccatgtcagtaatgagttaagtactacaacttgtagtttaggaatatgaactttgaattaattatttatatttgttatttatcataaaataagattaattgaaagcaatgccctttatggaaagaaaaaaagctgttaaactatcaatatctctaaggattcccttcttggttcttacaacgatttacattgctcaagacaaataatccaaaacaagtggattagggatttactattactattactattactaacttactgttgaagttacaaatcgaaaactgaaaagaaaaaaaaagggatcagaccggaagactagttctaaagggtggcgattggatcaaaatcgcggggaaggaagaagaatcgagcttgagcgaagctctgcagagagggcaattggagtgattcgttagccacttgtccacgcactcacaatggaagctgtggtcgcaccctggaagaaccttcagcttgtcgccgtcggcgaacgcgccgaggcagatgcagcactccgtctcctccgccgcctccgccatgcggttgcgcctcgggtggaggacgatcgggagcctcttgatcgcggcggcatcgaggccggtgttctgcggcggcgggacggcgtcggggaggaggaggccgttgtggtggtggtggcggcggcagatccggcgggcgaagaataagaacgcggtgaagaggaggatgatggagaagaggacgataatgaaaaagagcttgcggccacggatttcgagggtttcgtcgtcgagttcagtgtcgtagtgccaattcagtgattcagagtcacgaatcgacatcgtggagcgaaacgacggcgtttagaatcgccgcacagtgatgtggtgtgaacctgcaatgggcacagaacagctttttgagtgggttctgtatgttgctcaggctcagactgcttagtgagaagggatagaaatgaagatccaaatagcattatttatagttacgtttggtgattaggattaggtatactctctcagtggggcacacgactctttggggttttcaattttatactaagtgcaagtgtttatcttaataatgaaaaaatgcttttaaaaataataataatctaaacaataaaaaataaaaacgagtgcgtatttagtttatcatcatgtttgatttacatctagcttattgtgcacaaattccaatataaaatctaaccaccaatcaagattaaacgaaaaaagaaggatgcaaatatttttgttaatcttattttattacaaacgtctgtttagaaacggttacttttagaaatagtatctaattatttgtttttaaaagttttttctatataaaaaagtatttttagaaaattaaactaaatacacattctattttaaaaataattgtttaattttaattttttcccttatattagtacaaaaataagggattgtttttatataataaatttagtcgataggtattttatttaatttaataatttgaaaagtatatgttgatgattacaagaaaaattaagtgattttcaagcaaacaagttaaattgctctcttacgttacatgttgtccacttatttgtttttttttaacgtacacatactatacaaataagttaaactatttcccttagaaagtaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattattatttataatttataataatttaaaatcaattaaggttgatttaaataattaattaatagaaatataaataggaaaataattatatatgaaaatattataattttttttaaaagaaaacaatctcatgtgcataaatgtttgagcttaataattatattttggcaattcttaaatataattatttgtctatttatattttttaagctgaaacgtttatttgaagttattttctgtcaataattaaattttggcaattttcaaatcgtgggaaccgaaatacgaggagggagtgtatgttaaatcatactataacacactaagcaaatacattatcactacgaaacaaattggatgagattacatacttgaaaatttaagaataaacttaccattcaaaaactacgtgccacacatgcatcgctgttggattattacttgctgtattattttatgtttgtttatttgaaagaaagaaaaaatgacagagatttttttaatttaaattaacgaaaattaaaataatattgatagaaagttaatttttcattttattttctctcaataagataaataaaaatatatcattattcatatgatatatatatatatatatatgtatatatatattctatcactattacttttaactttaatttacagccggccccgacagaggggattgagccctatcttctaacttttatgcagtaaaatttgcgtgtaatcacacacaaccaattaataactatcgtactctatgactttaactgttattaaccagttacatgtgctcaaagaatttttttgactttatctgaatcaatgtagagaatgatgtccgaattcacatttgtagataagatcgacaagtttaatttttacggccttttcacgttacgcgtttgaattggacggtaaaaatttcttgccgttagcaattttgtaatatttacctaataataaaaaatcattggaaggagataattatttttttatcaattattgtcgactaaagttgcacgttcatactttatgcatatgcatgtaccgtagtaccgtacatgatttcggtccattaggggtaacaccgtggtaccttatccgtaacaatgtcggatatgcaacaattttactggatgtagacgtacacaccaaatggttttaatgttacgtctatcattcaactattttgtctcacgcgaaatttttgggtttatccggatatatatattttttaatccatgaaaatcaaaattaatgtaaaatcagtattaaaatttttataataatttagcatcttatttaatcaatcgaattaaatctattgactaccaaaatgaatataataatagactagtagtgttatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagattattaaagagaaaaatagtgttaacgtgctatggaaaatgtttgcataaataatataactctacatttagtttttattttaaaataattattatcttaaaatttaaaaaataatcaagagattcattaaatcattttaatttaaaataataatatgtttatatatttatttattatatcttttatattattaatgttgttttctttcggttattgaagatttatataaaaaacaataaaaaagttggaaaaaatgatatatattttttattttttaaaaaaagactctccatgaaatcggggaatttacgcaaataaatgatgtgtcatatttgactgaataacatatattagacttaacgaggatgactgacccaatgtctcattgaaaggttcatttttgaattaacttcacgctcaatcgatttatgttattgcaagaaaatcgtgggatttgcataattaatggcagaataacataaatttagactgcatggaataaccggcacagagtttgaagtcatagttgttattatgagcattattattccgtgagcgcctatgtgagcatcttcaataagatatgtttaattgggtttcttcaccatctttttgcagtctttttagtatttgttgtgattcttataatatcatatcactcataaaaaattcatataacattttactccaatgtaaaaaatcacaaaaaactacaaaaaatccacacattcataaaaaactacaaaaaattctaaaaatccacatatttatatttttttattacaacttaacttttttcaatttttataatacaaataaaacatatgaataattgaagaaaaataaaatataaattaaaaataattatattttgtatgagaacatttaaacagctatttcgtgtattgcattttttttttaaaactaaaacccaacataagccattaagcttactcccccatccacacacgtgtccattgtcgctagaagggcttttgcgaacttctttcttctcattctccacgcatgtcccttcttcagttcttcacttgatatttctttctttcttctcatcatttttcccaaacgaagcgcatcccacttcatcttcctcgagccaaattccttgcgccaccgtcgtcgctgtcgcgatctcttcactcgcgcgcgatgtcttctccaggcaccaccgtcggccgccacgacctcttcctcgagcaaccatcgcccgccgccgtggcctcttcctcgcaccatctggtttgttatttttcctcttccttttgttgggtagttgatctgaaaatgatattttattgttaagtttgagttccttatataagaagtgcatctctctcttcaaggaacggttccgccactcaaacactttctaatgaaaaattccttcacgaaaccgattcttcaactgaaagaatgcttggagcactccgcgttggagatgctcttagtatatgttatttttttttgtaagatttgatttactctcaagaaatatatttaattgatttagataacattttataaattaaaaatatatttggcaaaaaaaaaatataaaaaacaaaaccactatatccacatttcaacatacttaatttaggatcattcactaaccaacattgttttgcctattaatttcttttaagtcgagtgtttgtagaacaattttttttaatcactataaccatatcaagaaatttatttagttatctttaataaaaaaaatccttttaattatattttttttattcacaaaaattaaatacgaaattttattttaaaaactaaaccttattccactcattccacaacttattaatgctcatgggataagtttgaatatccttattgttgttcttgtcgacctgaaattttatcaaattaaatttgtaaattcaaactcgtcccaataatatttggaacaatataaaacagctcatttttttaaaggccaaaaaatattattaccaataataatgtctgggctacaagctataaccaacaccagaacactattacaaaagaaaaagatgctgacaaaaagtaacagcatcgacaaagcctacaaattaatctaaacaaagagatcatatttggtagggatgttcgcggtctggattggatcggttttgaagtaaaaaaattatccgattcaatcctttcggtttgatcatttgatcatccattcggtttgaaatttttttcaaatccgatccaatctaatccatttttttttggtttggattggatcaatttttgattttttaaaaagtctaaaaataaaacttatgagacttatttttatcaaaataaggaatatctagcataaacaaacacattcattgaacaaaaacaaacatcattttctaattttcattggacaaacaccttcattagacaaaataaggagcaatgtattggatttttggtttttggactatgataggaaataggcccaagtaggtaaagggtaaggtaaggtttataattggatcggttttcatcagccgatccgaaaatcgatccaatccaatgaaaattttcgattttttttcggttttcaatttttcgattttcaattatttcggttatcgatttttcggttcggtcaccgcagcttgcatctgtttggatcggttgatgaccacccctaacattcggtcttctcgacaaaacactgactttgtttgtcattttgaatttttttctcaaataaaatattaaaataggtgatcaactaaataggtgacatacattggttgtaaaaaataaccaatgttcttttatatatataaaatattgaatttaaaaaatgattgcgtcataaaggagtatgacgcctcttgcattttacatgataaaataatccatgacaccacccattttgatatatttttggaagaaagaaaaatcaaaatcttaaaaacgtgcaaaacattggaacaaaaggaaatatagtagtaaaaccaagcacaatgtttctgctcgaggcttatgcaactgagaaaatcctagctagctcacagctgcatctcatcagccaatgacaaataatcacaagcaagaatcacacgcaaccaccagcatcatagcaataatagttttaaaccacggttccacgagcaatacatgaaattggattggcacaccacgaagacagattagataaatccctccttgcgagctctaatccatttccaagctagaacctttgcatgatcttgaattgctgccactgagagaatattttctgagaacaccactttattccgtgctaaccacagcccccacacgaatgctttccttataattatgttccagcaatctaaataattttgaacacccaaagaactggaaaatatgattggaaatgttatttggccaagctgagactaccctcaaccacttgaaacattctgtcaagacctccgatgcacatgtacagccaaaacaaatatgattcaaactttcaagttctctgttacaaaacatagtaactcgtaacaactcaatttgttgacaatattaatcataacattatatatattagagacatcatacaattaaaaaaatatagaactattataattttaataatgtatgattgattcttttttttttaataaattacactttctaaaggaatatgacgcattagaccaattaagatgacccgaaatgtaactcaacttcatcctagaaatataagaatataatcttttaaatctaaatgcacgtttgaattaacatttaatttgtaaacttaagtttggataaactaagtttgaaaaatatctcaaatcttacttttataactgaatttttagtaaaaaatttactgttaaacttatttttaagcgataatcaagtttgatcccaaacttattttaccaactaaacatactttgaaaattcttctgccagaaatacaaacacaccctcaaaaatcccttggaaagagttatcactttccgtagttccgacgtgataagccataatataaggttgttctgacattaagccgaataaaacattccataaaaaagaaaggttacatatttccaacactactgagtccattatactgacgtcacaaaacaatatgacccgtacaacaatctgatctagttaaaacttcaaattaacttgggccgaacattaaaccctatgcatttttgttgggagttttttacttcacccaacatatctcttcatgcatatccaataatgagaggtaaaactaaaaatatctttacatatatatagcttatacaattattttaaaaaataattaatatcattatataaaatattaaaatttataatatatatttaatatacatatgaatttatataatacattttataacaattaattttgatctaacaatacatttttcacatatataaattttaaataaaattatagatttaaataaaaataataaatttaataaaaatttatatataaaaaatatattattatatcactattaattattacataatttattatgtaaacttatgtatattaaatatatattagagtattataacatataaatttatataataattatttttgagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattagagtttgtaataagtaaattattttcaacgtccccaaatcaatattgggtcatgctaacaagaacataactctgaagataggagaatgtttgcatcaattagacaaataaaaagaattcttttttacagacaaactaattaagaacaatgtttattaacaaaataataataataataataataataataataataataataataataataataataataataatacagcttttttttctttttccaatcattcaatttctcaacttctggtttcacagttaaaattccatgaaaacctagaattatttgatccaagacaacaatgactacgtacattacatttaaacatcactgatcagtgcatataacttaatcatactttgaattgaagtccaaataatagaaagggcttaccgcataatctgacgaaaataatggcaagatatataactccatcattgatttgcttcccaatcaccagcagcaaaatgtatttgcactgcagttagtattctacaacaacactaaatctcaaccatgaaaatgattttatttaattctaccacgcacattatccacaattaacaattaatactaacaagcactaatctttcagcgtcgtagtctacccaacattttattaacaacagtatcgatcaatctatatgtgatcctcttccatcacgatgaactaatactataagttcaaaccaatcgaacgatataattaacttgaacaaacatatgttataattctaattaattaatcaagcaatttcaaactcaaatttctttaaagatcaaagaagaaaggatcattataatcccataaactaccagtgtagtcatcctcgttcgccatggaccaaaaaggcgaagaagatccaagccccactgtcccaaccaacgccagatccggatccaccgaagaagcatccatagtagacgcaaccgaacccacaacgggggaattattcactccctccaccaccaccatattctgatgttgctgttgctgttgattcgacaaaaccccatgttgcacttgcacatgcacatgattattattactatccagaaaaccatgcctttggtacgaggttgatctaatagaaccatcaacaacaacaacattattattcccacctaaacccacatcggattccgaattatgttggtacgatgttgatagagtatgtgccacttgcccttgcaccacttcctcaggacaacgatggtgatgaggatgatgaacttgcactatattattattgtgattatcattagggcacagaaccggtggggtgtaagtgtaattgtgactattgttataagggtaaggcacggtggcggtggcggtggcggtgttaaatggaaaattgaaagaaaaacctgaagggcgaggaagcaagggtcttagggtttgggtggaagaggaagaggagcgagaagaggaagattgagaagaggaaccggagggttggaggttaagctgtgccctggaaccgtaaaggatgatggcggcgcggtcgtaggctctggcggcgtcttcggcggtggagaaggttccgagccacttgcgcgttcgcttgcgtggctcgcggatctcggcgacccatttgccccagcttcgttgtctgacgccgcggtacctaaatttgttgttgtcggggccacctttacctttgcacttacgactactgcttttgttgttggtgttactgttagatgtttcgctgggagtggtttctgtggtggtggtggcggtgggtttggtttcttggggttgaggttggagagaggccattggttggttgggtccagtttggtttataattatctgaattagattagtgggggaaagatggatggagacgcttgttgttgggaagctcgttgttgagtcagtgttgatgttgattaggctctggtgggaaggggtttcgatgtcatctctgtcaatggtggaattgggcggtgtaacatgcaatttatacaggagagagaaaaaagaagaagggattggtgctgtgcatcgaatagagtaccacaatagtattggtttcggaatttggaatccctgcttctgcttcttgcttttgttgattttcttcgttttgtttcgagactagggttatggtgtttattgcttgggataagttaattaaattaattacttcctgtgctgtttactgaaaatttattattcctactttcccagacaactaaactaattattgcactgccacctaaggatttttatttctattgtgccttgcatttgcatcaagaaaaatacactcagtaatttttttaaacacgagtactaagctacttcgtttgtttaaatatagggagtattaatctttatcacctcttgttgcatatattggcaaattaactagtagtatcacacaagtttaattttactaattaaaataagggctacaaaataaaaaccttgtagggtgggaaatggcacaactgtcattttcatttttttaaacaaatggctagatattggtcccagtaggcaaccatgttccttttgttggtgttcaggagatttagttgatggtatctaacgtattttatggtaatactacttgacataaacatattccagccacccttattttagtcacacatattgcattggattatgtggtagttaaatgtttctaattaatgtcggaagtttattcttcaaaagctagtcataattgctggataaagtacacacatccatccataagcgccaccttcattgaactggcgcgcgcgatatatatatatatatatatatatatacacatatatatatatatatatatatatatatattatggtttagctattttaaaccttttggggttgaaaaaaaattcggttctttgtttggctcatcttccatgatgatgaactcccaagtcacaacctaattaatacgtactatatatacgccacgaaagacaattaacttctagtccctcttgcaacttgagtgcacatgccattcaagatgcatcatattgtctgtgtaattgcacaaaagcttgtcattttttgggaatggctggattttcttaccaagctgattttgttgctttagacatcaaaagctggcttcaccccttcagttacggcatcaatacaaccttgtccgtcttgtcttgttatatatatggtggatttgtatgcttccatatttgatatgatcactgaattagtacgtttgatgtattagaataaatccaattataatggtcgtaaacatctctcatgtgatgatgtgattagagaaagcatgcatttcgctagtactagtactagtcatttaattacttcattttttcttgaaaagatccttaattaattataattcacaattaatggtcatggcctctaaatctttgaggtttttgaatcaaatgaatatatagtttattccaccacatgattttttaaatttctctcgtcatttttcctcgtttgattagtagttaccataactcttgtaacataatcattggtagattcaaaattcttatgtgcaaagattcaatcacacatttcaggtttaatttgaagacacattttcaccttaattattaactcctttattatgaacattttgaagaatctcctaagtttaattatttttcccttattgcactaaaaaatttcttaagcatgcatgccatcatctagagtcgcatgaataatgcaaagaacatagatccattcgtaattcttttacaaagtgattcttcaggcttgatccaatactcttgttgggaatatttgtcaaattctcgtatccttattccacgtaccatgcatccttcacacataatgaaagtcaagtataccttcacatgaacacatatattatgaaagttatctaacttgactcatagtttaaattggttataaaaatgttgtctcattttttaaaattaatttattttcttatttttttggctttgttatcgtgaatattttttttgtattcatattgttctaattctttcttgtatttctttcatttttttattttttaaataagtgagttagcttgtgaatctacccaccaaacttaccaacctttagtgaattaaattattatatttttcactcactaaagaagtgagattgaattagtttgacttactttttatgtaaccctgtgagttaacacaagtaagtcaaattctattactttttatctccgagagtacttcattttttaataacgtcacttttcattttacatattattctctcttttatgaagtttcttatgaatgtctttgtactgcctttagtaacaacaaattttttttaaaaaatcaatcttgataattaattttaaataattaaaaataaaactttttattgataaatatttattataaaagcttacaaaaagtatagccactcttcttaatgtaaatttttgttttcagttactgaaaatatcctaaatactgaataaaacacacacacacacacaacgatttgatgattcctttaacttcattttggtctcgttttttactagaattttttaacatctattataacttgtaaacttgtgcattaaatcttttatcccagttgcactgatttagttcgtttgggaacagtttagaaaagatgaacgatgttatcagaatatttgtaagaattaggagttatactattacagaaatttcttattgttgggacaacgatttatagaagtttttttttttttttttttttttttttttttnnnnnnnnnnnnnnnnnnnnnnnnnnnnnnnnnnnnnnnnnnnnnnnnnnnnnnnnnnnnnnnnnnnnnnnnnnnttttttttttgtttttcaaatagaagttgtctttaaggttgatggatgtgatactgtagtgtatagggcccacaagtaaagctaagcccaagacggtccaagatgaggttagttatatgggctcagatgaggtccaaaaataaaaaaagctgcttccccttttcctttgcgaattgcggccggctttgcatcttcaacttagcaacaaaaagagatttagaatgtccaaattatccaatcaaaaatttaatcatgtgatgagtttgttaactttaataaaaaaatattttaattaaaaattatacacttatacttataatgaaaatttatggtaattatattataagcatgaagtatttattaaattttttatttcagaaataactttgtgttataaagttaatttttatttaaaaatttgattgatcgtttttcatgaaatcttctgtcttaactatattttgttttatttacaaaactcaatcttaagattttattcaagaaattaaaacccatttttttgttagtatatacttgtactaaccatacacaaaaattactctaaaataatgctcaagaggtgcttaagcgcttagaagagaatactaaatgtatatcaaatattaattttatattatgttttaatgtaactggcaagtaataaaatacttaatagatatcacatctaatattgtttttcttgtttactgctaaccaagttgcaaaaatatagattaagagagagaaagtattcaatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgtaaaatgcaaatatatatttgagaaagcgtgaacattaatattgattaacatgaatattaataattaaaaagaatagagttgattaaaagtatcatatataacttgattaattaaaaatattaacaataatctaattttaactataaaactttacaacttcaaaaaaataaatataaacattacaaataaaattatttaatttaattgaataatattttttaattttagttgtaaaatatgatgaacatggaatgcagatatgaacagaattaaatagtacataaatttatgaataaatattcggatctaaactctctgaaaaagtaagatgttttttaccatagatattttttaatgtgtatccgattctcattcttataaatatactgcttggtaatctgtcgtttatcatggtctgtacttggactcttcttgtattttttcggcattagcactgattctgcccttaccctatatatatatatacatacatatatgatcttctttttgcatagcttagtaatatattattgtccataatcttgagaacaaaaccttcaaatcagcgttacacagccccgtgggggatatagctagctaggttccttcaaaatgggaacaaagggatatgtaaatatagtttcttattaataaattaaatagatactataaattttagtgtccatctatatattgatcttgtgtctttgcttttatgaaaagacgtgatgggcatgcagcaagcaggacaaaagaggcagccaaagcaacaaggaatcagataatagtgcaagcaaatttaccaaattttgcatgcagatatccatgcatatccatcaagaaacaaagttaacaagattttgattacttttttgataagccctaccctatagtcttttaatattaattaacaacactttaatttaaagcctttagatagatgcacatcatcttaattaatctcgaactggatccaagtggggggaggagaggtcctatcgcctcccctatactttattcattaataaaaaaatgttattaaaaaatcttttttcctattgtacgattctaatccctgaacacagactttttttaattttaatttattttacctcctctagtgtactattacgctaattgagaaccatatgcatctctatctctgcactggccatatttttgtcttgtgtggaagaaggagaccacgttagagagaatctgcacgagaattaattggccggtgataattgggaatttgactaaggtaaagactgtggatgtgtccttgtcaacgtcatgccgggtaatatactacatgccatgtatgggacatctgaaatagccaagcttatttaattttttatatataataatagggcatataagagaactcatgctaaccatgtataggaataaacttaagatatcttgcaaagaaagttagagagaaaaaagaaatgcaagaagcttttgattagcactgaattagcttacgagtgtttgttattatagttggttatatagttagttataagaataactaatgttacggatgaaagtaagtttgttatcctcttgtttgaagtagtcaaacacccgctactggcccacgataaccacccaggaaggtgggatatggccgttatcccccacgagccaatatctccgcatatataggaacgatacgttggcttcaaccgcttgattaacaaaatccaggtatcctataaatacatcacaattcatggtgaaaggtacacattactctgaactctctcttttcacttcacactagcacacaccgcaccccccattgtgccgtgttactccgtgtgatcttcttcctcgagttgcttcatctgcataagcttcttgagagagagagttgatcctacataaaatcatccaacatcattgttggacatttctgttctctttgagcagaacaactaacttacaattaactaagctaattctagttacaatatggtcaagttgaaatgatcatgatcaagtctatgctaaaagtctccttcaagttaggaatgaatgttggacatttctagcttggaatgtaaaaactgaaaagcactaggcataagagctttggtgtagatatttgcaagctggtttgcaagggaaacatgaagtaatttctcaagttcttcgagcatattctcacgaactatgtgacaatcaatctcaatatgtttcgttctctcatgaaaaatcggtttgacaactatgtggacaacagatacgttgtcacaatacaaaacaacatggtgctgaaaatggatattgaactcttatagcagaaaagtaagtcattgcaactcacaattgacacttgctaatgctctatactcagcctctgaagaacttctgaacacagtggcctttttctttgacttccataagatcaaggaactaccaaggtatatggcataaccactgatagaccttttagtgttaatgcaaccaccccaatctgaatcgctaaagcctttcaagtgattgctactgttagcagaaaggaaaatccctgcacttggagatcctttgatgtatctaaggattcaggatgtagcttgttgatgagctaaggtaggttcagccacaaactgactcaaatgttgaacaacatatatgtaatgtctggccttgtgttagtcagataaatcaatcttccaattaatcttctgtaagaagaagcatcctctgttgaaagaggagaaccataatgttggtgcagcttggtgttggaattagagggagtagacactagcttagaaccaagcatgccaatgtcactcagaatatccaaagcatactttctttgacatagattcatgccagtaggtgttctaactactttaaaacccagaaagaactttagatcacctagtcctttattttaaaagcactgtctaatatatgtgtaatacttcgaatctcagccaaatcattttctgacaatacaatatcatccacatagaccagtaaagaagtaatggaattggaactatgcttgagaaacaaagaataataagattcacacagtttgtagccatgtgaaatcagaaaagaggatagtttggcataccattgcctacttgcttgtttcatgccatacaaagacctttagagttacaaacttgtcttggcttgtctgactgcataccttgaggaagaaggccattgattaacagtagctaaagtcagtaaaagtctaactgtagttaacttagccactagagaaaaaatatctagatactcttgaccttctacttgagtgtaacctcgagctactagccttgccttatatctcatatccatcagaattgtgtttgatcttatatacccacttacatccaatggcagctctgtgaggtgaacgatcagtaagaatccatgtattattgtgctccaatgcgttaatctcagcattcatggcttcaatccaataggatctttagaggcttcattgtatgacttaggttcaacttgttgtgggaaagataggataaaacaatgatcagaaagagacagtctgttgtaggaaagaacacaattgaaagggtaaaggctagtacctgtagagtgactagcaatagttgatgatgaatatgtgatgtgaaagtctttatattttcttggtctgtgtatctgtctcatggatcttctagatgtatgagtggctttttgagaaatagaaggatcaggattagtaacactgggttcaacaacaatatgatcaatggatggttctgaaggagggtcatcaaactgatcaatagtatcattgaaagaagaagttagtacaggtaagaaggtgatgagatcatgtttatcctgagcagtgaatgggaagcaatccttatagaaaataacatttatggaaacagaaatagccatggttttaaggtcaagagtgatatatcctttggtgtttggcttgaaacccagaaaaacagaagtagcagctctttgatcaagtttctttttgttggcaattagattactagagaagcataaacaaccaaagactcttaaagaaccaatatcataagaagtcctatataggttttcatagggagttttattgccaagaaaaggagttcatatgcaatttacaagaacaatagagtgaattagagcataagaccaaaaaatagagggtaaatttgattgaaacaataaggatcgagctacatttaataaatgttggtgctttctctcaacaatcccattttgttggggagtttcaacacatcaagtttgatgtataattgtctcataatgaattatgatccattatcagatctaatcattttcacttttgtattaaattgtctttcaacagtgacaacaaagttctttaaatgagattgggtttcagtttttgaatgaataagaaaaatccaaacaaaccttgaatgatcatttactatagtaaggaaatatttatgatcatttaaagaagtcacattgcaaggaccacaaatatcaacatatatgagagcaaaagggttggaagaataaaaatcactgccagaaaatgacaactttttctattttgaatgatgacaagtatcacgtacaaattatttatcagatgtaactatgtaagaagaggtatgattgctttaaaaatagcaacctttcaaaagatgggtggactaatctaaaatgccacaagtctataggcactttattacatgaaaaagttgaaatactagaagaaacataagttgtaatagaagtgggattatactccttgtgaggcttgagaggaagtatgttgagcttataaagatcttccaccatatcaactataccaatcctttgcgggttttgcatatcctgaataaaacatggtgctttggatttctgtcgtgttagtgaatagtgaaggtcatcgacgtggtggtgggtggtgccgatgaggaaaggagaagagatcagaatcaaattttggggaaaaaaactaccattaatggcaatacaactttatcatacaaaaatataaacatcaagcttgcccgacattaacaacggagaagggaggttaggggtggtggtggtgggagtttccggcgaagccaaaacagaagagaagagcacgcttgcatggaaggagattaaaaataaaaaatagagtcaagacatataaatattaaattattattattattatatttaattaacctactaacatgttataacaagttaaaatcacttccataccagtgaacatgtatttttcaacctcactttagaattcacccttttctaagcttgtgcaatatctaagcacatattataatccttcgaatatctcaaacgaaagaaggtaatataaaacatatatgtttagaagagataaagataaaaaccatccgaagaccccactccctaaactgttctcaattatgtggatccatgaaactataatttgtcttacttcggggttagcgaaaaaaatatgcaacaagtaggtaaacacatactatatttaatttaagttctattagatttcataaagaagtaaatagaaaatccctttgaaaattattgtattttaacacgaacagtgtgttttaaattagaaaaagtaacatgatgaaatttctatttgactgtgactccatcaataatatgtgtatgccacatgtatacatgcgtaaccaaacctaacatgatgtatttattatatgggcaatgctttgaacttttatccgtgccaatatatcctcccagtgagtgcttttcacctattgccttttaatacttttcttcataaaaattctgccaggtatagctagcctatggcgacacaaactggacagaatgaccgacaggccggtgaagcaaactactgcctcaacctcatctccaattcacagttcacaaacacgacaccacaaaaataaaatcagtaaattttgtatatgttaattatatttttactaattttatactgtacaagtatatataaccaatgtaaaaacgatgtaataaaccctccaagtttaatacgaaattcctcacaccacataatatattaataaaataataaacggtctagatttttcacagattattggaagagtctttttttttttaaatttacttttgatttatttttgcaatttcgttgccgcgttaccggtcatcgttaactcactgttgaccgcgttgggattgacggcaagactcaccatgtcaccgttggagacgtcgatgacgattccaatgtcagagtcaccgccattatcgacgccgcggtccgagttcacgcgcctcttcaacatcagcaattcatcaatcatatttgcagtatcttcagtcactgaaaaaacacgtggactcggagatcctgtgcgagtgactcagttcgacggaggagctgagttcggagtaaagcggcatgctccgcatggtgctgtcgaggaggttgatgccgatgttgagaatcccttgagggcggtccaagggacgacgaatatggagggcgacgaagcggagcttgggtttgtggttgggagggaggaggttggcgacgaggtcggcgacggtgccgatgaggacatggcggagccaggcatgggagtagatctcgttccaggtgggattggtgtggccttcttggcacaaccagtttccagttgctgatgcatcatcaaattttaatccaatgcatcatcaaatttccagttgcgctattctccgaccaccaatccatgcccaagatctccgccgtgcgcaacacaggtggtggcatggggtacaaccccttcgcgattgccgtcgccgtgggagattgaggtggtgggtgggtggtaccggcgtggtggtggatggtgccggcatggtggtagttggtgcaggagagagaaaggaggagaagagcgccaaaggaaggagaaggagaataaaaaaaaattaaaatgattttattttacttattatattttttcttcctgttattaacttattattatctgtcaattttgagattcaccgatgcagtccaaaaatggaacttcatattagacgacttggccgtaataaacagaatttgaaaactatttgtgcttggcgatgattgagattgagggagtaatagctatcagtccaacccaacagacaaaaaagctagcgggcacatctgttctacagtgtactacattaattgttttgatattcattttcttccataaagcgatgcccagagaatcttggccccttaatatcaagttcgtaaataaatgcatgaccacactcttctccgaacatctcgaatgctgcaattgattatactagagttgggcccctacatagtatttaggaattttaataagttttttcccccttcattcttaaaaacttagaactgtttaaaatagtgatcaattgaattcggatacttttaaagtatgtagttcaaaaaaaatataattaaaataaaacattattaacggtgatgaattaagttgtttaataaaaactaattatgaaaaaaaactgtttaaaacagttatttatataaactataattattactgttactacaatatttactccaatgataaaagtcgatgagaattgcttcttaagttttgagaacccacgagaaattcacctgttcttatattccttataaatatcatccatttgtagcttcactcgtactcgcactcacactagcacgcttctgaattctttcactccacaaagtatatgcatctcaacacaaccatcttaaacttctcctcccaaagcccaacttgcaaaaattacataaattccttgcccaaaaaacttgatcagtgaacaaacatgggaagttccgtgtgcgtaaaagaagcatcagtgattacaccttctgagcccactccatcaagtgtgttggctctatcagctcttgattcacaactcttccttcgttttaccatagagtatctgttggtctacaaccctttcccaggcctggaccaggctgccaccacggcccgtttaaaagccgcattagcccgagcgctggttctttattacccttttgcgggccgggtcagacccaggcccgatgggccgggcctggaggtggtgtgcggagcccaaggtgcggtgttcatagaagcatccgctgaccgttacaatgttcacgacttcgagaaagcgcctaaaacagttacgcactggaggtcgctcttgtcgctccacgtgacagacgttctcaaaggattgccgccgctggtggttcagctgacgtggctccgcgacggcggcgccgcactcggcgtcgggatcaaccactgcatctgcgacgggattggcagcgcggagtttctaaaccacttcggcgagttagccaacgagaaacgcgagttattattaggtctcaggcccatacaaaaacctgtctgggagcgtcaccttctgaacccgccgcgtgggaagcagacactggttgactcaacgagtcaccccgagttcaaccgagtcgctgatttatgcaacttcatgaacaaggtctcgacggggcttaaaccgacatcggtgaccttcgacaagaggagactcaacgagctgaagcgactcgcgcgttgcacgagtcaaccaggcgagtcggtgtgttacacgtcgttcgaggtgcttgcggcgcacgtgtggagaagctgggcgagagcaataaggtttccgccgaaccagaagctgaagctggcgttcagtgtaaacgtgcggaaccgagttaaaccgggtttgccggaggggtattatgggaacgcgtttgttttggggtgtgcggagacgagtgcaaaggagttggaggaaagagggatagggttcgggtcgggtttggtgaagcaggcgaaggagagagtggggaacgagcacgtgaggggcgtgatggagttggtgtgggagagaaaagcgtgccctgacccggttggggtgttgatagtgtcgcagtggtctcggttagggttggagaagattgacgtgggtatggggaaggttgttcacgtgggacccgtgtgctgcgataggtactgtttgtttttgccggtgagggatgagtgtgtaagtgtcaaggtcatggtggctgtccccactcacgccgttgacaattaccagcttttcatgcgcgcgtcgcacctgtgacttgtgacgtaaatggtttttttctccctggaagaaccgaagatagcctgagaaaatttataataattataacttaggtattttgcttaattaatcgaatttaacttttcacgataaatgtctgaaatgccccactcactcattcccacacttctcacaagtgtgttttgtcctactttttgtagcttttgagttttgacccaaaatctaacttattaatcacggtaaatcggtaattttcgtacactgtttggttagacaacaatcatgattttcttaaatgtaagttatttacgatgtgtatcaagttttacatgtgtgtcaagtttttttattaaagaattgattatgagtttaaaattaattttagataatttttttatatttgattttatgtggtggaagaagacttataattaattttggattgaatcaacttttactagttttttttattgaattcaaaattttgtattaaattttaattttaacttaattttatgataaaaacatttatacataaattatattgttttaaaatcaattttattaaaaattaattttgacaatctacattcaaatacacagagaattgggatcgaatttagattaaatgcgctgaatggttatggttgaggttttacgaataagaatcgagattggtagtgtgtttgcattttgcaaaatgatgaaatgcccaccatggcctatctcacatggtggaccatgaggcgctgtggcaacgaaccaagtggcacaagctctatcgatcatgtagtacagggaggaacatgatctcccattttctaatgatgtaatgcaaggatgcgcctttagtagctttcaatgcaatcactacgacactacttctctatctatatgagagtcttaataattagtaaagaaattaaggataatcaaattttatttacataatgcaatctgtgcctacgctatattatactatgtaattatgtatagcataattttcttagtctagctaacatctgtaattttagtcaatgtatcctcttgttacttagttgactaaatctattatgtgttcacgagtgatgagtttaattgaagcatctgaagtaatttgaaacattcagataacatactacaaacgttgcaataaaaaataaaataaaataaaggaatgtagatagaagtgagaagctacaatttggcattttagcatttaataattttagacttattagtgatcacgtaacaataaaagataaagattgtgtctgatactattcttcctgcaatattaatatatgtttgacatgcatgtgatggagagatttaaaatttagtagcacagaacgttatgcatgctcacgataaacttctgtccattggcaccataagtttattttggttcttggccttgctggcttattctggttgttcagttaccaaaccatgtttttgtgggtaggcaccccttgacccttgtgccatcttaatatatgattctttttttggctgatgaaaaaaaaaaaacttctgtccatttttaagagaatgaagtgtatatttataagaactctagagaatgtatatatcatttttggaagagaatatgcattgacaattgttgtactttaattgaagagtgattcctataaatcatgttgtgttaaacttcctcagaaacaacatgattggcattcgttttgatgggttattgacttttcaaaatttatgattgaactttgacggctatagtaattttaattgtctatcataaagaataatacttgtaataagtaccaaattgaatattaaaataattcagtgattgaatataaataattaatatattaaaattaagattaaattatttatatcatatttgaatttgatttttaacaaaaagtagtcagaattacattctgacaatgaatcagagcgttaacacagaaaattgacaaggagaattgacactctcgttattaaagtatgctagtagcagtatcttgtagaaatttactccttaaaggcccaaatttctcccgcagcgcgcataattttcagcaaccatgcacgggattgagaactgtgataactgttgacaatatttcaaaggttagattttccggatctgctgttccatgacaagaatctttgacctagaaaggctgacgagggagccaaccgaaggggcattacgctaacttatgctgattaaacggcatattttgagggaaccataaaatagtaagttgattttgctattacaagacaattttagtattttggccaagaatatcctttttccctctgcctaattttttccatcatctaaaattattgatatccaaatactattattaaacatttatgcaatattggaatgagtgaaatgagatgatattaaacataataaaattcgctaggtagataggaatctattaaaataaaaactccattccgtgttatttaaatattttatgatggattggaagaaagtttttatttcattttttagtactgaatagaatgaaataaattagaatttttttatacatgatcagtataattttatttacactatcagttaattataaattattttaaatataatttttaaaataattattataaaaattaacaatatgtaattatatgataatctataagtaaataacaatgtaaaatactttataattagttgtatattctgattaagatatttttatattacccttattttaacaggactaatatcaatgcaatgtgatatcctccttcattctatcccttctcgatctaaccaggcccggccctggggcagggccagcagggcctccgcccagggtccaaaattttttgggtcggtaatttaagtaaaattttttattaaaaaaaataaaataaaaacaaaacctatgttaggggtccattttgtgtattaggggactattttttccatctcttaattttaatattatttgtatttcaaaaaatttgtgtattagaaacccattttttttatcccttagttttaatattatttgtatttcaaaaaatttatgtgtcagggacccattttttccatccgttagttttaatattatttgtatttcaaaaaatttgtatgttagggatccattttttgtgtgttagaggctcattttttcatccctaattttaatattatttgtatttcaaaaaaattgtgtgttaagggcccattttttccatctcttagttttaatattatttgtatttcaaaaaatttgtgtgttaagggtccattttttttatcccttagttttaatattatttatatttcaaaaaaatgtgtggtaggggtccattttttccacctcaccccggatcaaagaattttcaggaccgaccctaaatctaccttttaaaaacacatgtttactttgctgtccgaactttggtcgcacaaatttcgtggtgcgtagatggagaggttagaaaggaaatgctttggttaacgtatgttggatatctctccaatgttaccccaaacatacccaaagttttaaatatcccttctttgatcccaaattatcattcaatgaatcagtttctttctttctcataactaaacttcctgctgaatcgaacatataaagatgagtgaatcgacaagaaaactcaaaaaataattgaaatcagcaacatgatatagaaaagtaaaaaatctaaaaaatatatataccacttaacaggaaaactaatacttaattaattataacttatcaccatggctttcatgggcttttgcttagaaaatgagaaaaaaccaaaacagaaatgccataatgaatggaaactaagaagttcagtaacgatatcactttccgtatttgcaacatatattggtctatttgcaacaatatatattgggctattcatgggttgcatcatatagattggactatcgtaatgatttgttgggctaaaccttcgtgcacttttcatttcattctaaaaaattcgttttaaaattcataatcagctaaataatttaggtcctctaatttatttttaatgatcaattaggtcttctaattattaaattattcaaaacggtttaatttagttctttttgtcaattaaatattaacgttaacattacaatctaatgtgtcaaatgatgtggcatttttttaatagatgatctgtcgacaatgcttatatttaatcagtttaaataattaaaggatctaattgaatcatttaataattaaataatctaattaaacattgaaaataaattagaacacctaaacaataatttaatcttcataattatattttagaatgagctttttgaaatacaatggtaagtataagagtaatagtgggagtgcaggaaacaacagttaccaactcaagtaggatttgaacacaaaatcatttcattaccttgaaagaaatcgtgaacgggtgattgtcttttgcaactctttttctcaaaacaccctctatcactttttatttttatattccaaattctgaaatgtataaaataatttaggttaattaagtttttagtcttttaacttttttatattctaatttgtaatccctcaattttttttgataacttttagttctttattaatttttggtccttcaaatttttttttgcccatttttagtccgttaatgtaaaaattaatttctagaatgtaaaaaaaaaatgtattaaagaaaaacgggtgcgaaaagaagccccagtgatataaatggattgtctttttcatttaggaaattgattgagctgggttcagagtttctgatgtttcttatcgggccgtttgatagcactgtataagattgaaaattgacatttacatcacattttatgttaagttcacaccccacgattgtgtattttctttttatacaaaaatacctgacaaataatttttttaggagaaacagaaatactttttgttaagacaaatacagaacgaaaacatattttcatttcatcataaggtgtgcaagcataacatataaaatggaaacacataaattttctatttcttttattgaatttagcttctatatattgtaagtattaaactttttatataattaatttatcagaaattatgataagtaaaatatttaagataattatttttaaaattaataagataatcatattcaaatttacatacactatatactcctttcatttcccatgaatcacatgtatccttacataaaaaaaatcccaggactacgtactacatacactatctttaatcttggacaatagtcaacttaattattcctaagatttgataggattaacatagtaactgagatgtaatgcactaatgcatggttgcttgttgcccttttagtacgtatgggtgaacatgaattggatttttaagaatccaatccatagtcaatctatatttatttaaatgaattgaattttaaatatatatccatattttttaaaataatttgaattcaagatccaattcatttaagtggatatagatttggtcatatccaatctatatccacttaaatgttataaggatttatttttacaaattataataattaaacactaaaaagtgaaaacttagcacttgttcatttaaaatcaattttcaaccgaatttgatcgagattattttcgatcaatcttggttaagatattttcagcctatctcaaccagggcaattttggctaactaatagtcaaaacatttttagaccgacatcaaccaatactattttttggctggtgttggtcaatgcattttcggtggacatcgatcaaggatgtttttggtcaatcttaggtaagattattttttggttgaggttagctatgatttttagttaatgtcgattggtgatatattttgaccgacatcgactaggagtttttcgatcagcgtcaaccatgactattttttgaccgacattggttaaggtttttgtgggcgacatcggtaaagtgtttttgactgatgtcggttgttgatatttttttgccatcaaccagaattattttttggtcaacattggctatgtttttttgctggttgaaactatttttttgttggcgtcaactaggatttattggccaacattgaccatgactatttcttttggttgatgttgactagagatttttttttgttgacatcaactaggttttttcgataaacttttcaatgatgtttttctgccaatgtcggccaaaaatgtcctagccaaagctggaaaaaaaatagtctcatttgacatcgaccaaaaaataattccgacagacatcaacaaaaaaactttagctaaagtcgaccaaaacatagtttcgattgttatcggccaaaaaaactttggatgacattggcaaacaaatagtcccgaccaactttggcagaaaatccttaccgacattaatcgaaaaaaagtctcaatcgatgatggcttaaaaacatcatgagttgacgtcggttaaaattattctagatgacatcgaccaaaaaatagttcctaccgaagttggccaaaaaaacttagccatcaccgtccaaaaaatattattagatttaaaaatctaaataaatatctaatccatatccaattaattgaattgaatttaaaattaaaaaattggatttagatatgaaactagaacatttaaatggattaaattaaattgaatatgaattaattttatatatttgaatttttttgacagtgcttcgatgcttgtatattcatctgtaccatgcgatggtatataaatgaaacttgattgatcgaaaatttaaatgttgaaccttaatttccaatgtttgtaattcgctcaatcagacctgttaagggatgtcaagttagaagtcaaattatgtattgatctgaaatggtttgcaaaattttattttctagatttttttcatacgtgggatgatgaagatcaactgggaatatttatacttttcaatcatactaatgctattagactgagtctgaggctaggtagtgttggacaacttctttttagtttttagtttaaacaaaatcctaaaaagtttatgaagaacaaaagtaattttgtaatataaagaaaatataaaaattaagctttacatgaagtcatgaactaattttattagtagtttcccgtgtcattgttccaggactcaataatatattatccaattatatattttttaaatcacatatatgttttacgaaaattaatcctaatctaggaggatgtaattactataagtaatttattttccttttatgtatttaacagagttgttgcatgtattcaaaaatagaaagattgccaattaagcaataatggggactccatctccgcatcaagtcaaacaggttcagattccaatttacaaagggcgagatgaaaaaatggaacttgacccaacccatcccatgctcccacatccccaagttagggaaaatacgatcaaagtaattttttcttgtcagactttggacaggatccgacggatgtccacatgtttaatttttattgccacgtgtaaacaataacattgatccacttgttctgtagtatcccaaaatattaaaattactaaatagttttaacctcaatttaaaaaattctaattctaatttgaaagtaattttaattaagatccacaaaagtcaagataaacgtcaccttaatgtcggcaatagcttattaatgtcgacaatttggggacagatgatttgaatccatcaacaacgaccttaacgatgaaataaattaatataaggcaagttcatccatattggtttgtggtgtattaatgtatgagacggttaacgtaacttgaataaatgtcgagcgttatcttttgggtcatggcttgtaaggaactacactgttgtgccatatacggcaaagaaaaaactgttgaagctttacggtattggcattagtctttggattcctatgacatgacacggttaagcttatatatggaccatggtggtggggttggtgcgtgactctgaaaatcacaacgggtgctccgtgcgttgcaataaacagtacggttaattagacccacttcagagggatttgcaagaatcaaagtagctatagtagtgttgctgtctctatactaaatggtgtctcacacatgttggtggtgccattcaatactcaggttcatctggtccactgtctacatcacaaataggttatctgaattcacaatcagggtctttgttctttgttctttttcttttttttattaatattttttttgtttttgatggtggtggtggtgtctttactaagcaaacaacaccggaaagagataatcagaagaacatatatacatgcgtttggaaagcagagtttctttttggtcactgggtgatcaagagaagcatcatcatccgtgaaaatcctattataattattacataaatgaaattcaaaacacaaagaaaatcatcatttttcctataataatagcatggagaaaacttagctattgatccctttaggagtgtttttggtgttatttttcaatcagaattgaaattttacctcaataattttgcatcatgatttaatagaaacctttattacatgaattactaagattgaaattccaattctgacagaagaacaacaccgaaagcagccgtgcaacagtatatctaatttttgtcctagtagcataggaattatgaagctaaaagatttcaatgaagaccaattcattctagaaggtgcttgattatttatttgcatacacaacacagtcgctgcttttgatgattgatcagaaaattcagaacaattacaacgaaagagagggggggtgggtcataactaacaacatatctcaaaatatatatgggatttgaatgaaatcatccaccgtttcatgtctggtcaatgatgattgagacgaagaggtgtgacagaagttgtcattattgaaattatcagcacaagtgaaaaaatcagggaagggtggcaaactaacatggccattaatcaaggcatcagaagcggtggttgtagcagtagcagtagtagcagcagcagcataacgagcaagacggtccttagcaatggcaaggtcatgttgaagctccaccatcttcctttgcagcagagctatggcaccaatgcatccataaaccgggtcccgaagccgtgcttccgcctcataagcaagcgaattcaccgtgtcctctctctgttcctcaggaacctcaacgaggatcttgctcacattgcttgccccgaacaccttgtgcaccttggcgaatttcttgcactcgtcagagcgaaagtaaggtgcaaatatgcaattgggtatgcaccttctcttcaagaacttgcaagcggcacaagaagagcttgaacgtggctcataacccttcatggctctttcaattctctcaattttcactttactatagtgtttgcacttataagtatatggttctctcgataggtatcttgctcaatcgctatttaagggctaccacgtttccttgcctatgctcagctaggtagcaggttctggacttgcatgggtcaatgctgtctttttactgcatttattttatgttatttgcttttgataaaaaaatattatttaggttttctctagctagtatagtagtatatttaatttgccatctataccattcattcaaattgggagtgcaaaagtaggtccaaataattgattcatgtggacaatgggtggtatgagttggtagttttcaagtaagatatgatagttcatgaataaagatggccggggatattttgattgattgaagaaaagaaatattctcaataaaagcaaaattatcccttggcagtgagaggtatggtcactagaaggaaaccaataagatcgaattgagtactttagatgtagttggaatcttcaggtacagcatagtggagccaaaaataaagctagtgaattgttgtttttatgctttctatatcattcgatatttcgttttttccgttattatttttgcaattctagttgctttctaacaaactgaaacgggaagtttaaggtgaagaagctataggcctatagcacatggaaacaaactgagtgcgtgtcaaattttaaccacattaaactaaacatcttctggttggtcttgcatagtaacctaacatgggtttccttttcctttttcttttttttctaaaagaagaaacacaagggtgtgactgtgttaggggtgtattatttttttatataaaataaaccaaattagttacatattcttgctaattctatgggaattaaatatacaccatgcacatgcacatgaaaaatgtttttatgaaggaatttaaataaatatataaaaagaggctattctataaacatatataaaagcaaaaccaggagccaatcatgaactgattgatttccattcggcaagcaataagcccaaacctgactttattattagattaataattattcgatcaaggaatccataagattcaaaaattcaacttcataataaagattcaagagaaaaaatagagtgaccatttatgagggatccatacatgtattaacttttcattcagcctaactacatgaatccggacacactcctctcagtaatctagtaatcagactattacattcaatagattatctttaagtttatttattcaaatattattgataatattacaactatatttcaaataatatgtacttaattatatacaaaatacatattatctataaggtatgaattatctacaatctaattatctataacatataattattcattagtctttatctacgtgttaattatttacaaagatccaaggcccaagcttatgttataaatacaggtttcatttaacatttcattcatattcattcacacccaaatcaatcgaatacaaagttatttacttatcctactcatactcaattatacttttctctttataattgatgtatttatttgagaataagaatcatttcctttgttttacaaattctcattcttaacaaagttgactcatccaacatgcatagtctgaaattcatctgaaccacatttatctttatacataatacttccggtaagaaaaaaacatgatatactataaatttgatattgttttatctttaggaggccacctcacgctgaaattgatgtttacacagataaggattaaaacattaaaatattttatcattataactagataaagaagacattaaactgtattaagaaattccatattcgaaggttcaacctagtcgtagatgtcctataacgactttctatcattgcatattactgtgggggtgcaactgtaaagatttcctatctcattatggaatctaatataataattgtagattgcattgttaggtggactgatcatagcccagaatttggagggacttgcataatttggtgaaaccaatctcttggttctcagaccgtattttgacacaatttaaaattattaaaattagagtttatattttatgcattattaggataaaataattacgatgttaaccaataaaaatttatgaaaagtataaattttaaggtgattgttgttaaagtcaaaaaatttattgaacatattaattgatgattgaatgacaatattttttttatattgttaggtcatctctaatgttgttatttactagagttattttcaagttaagttgtttaatgtgattgttttagcataataacaaaaaaaaaattatcacaagataatatatattttttctaaataagttttgcatataataatcatagggttagattttagtcctcattataatatttaaaattttgtaaattagaaggaaagatgagtaaagtgtttatcaagtcaattaatttgaacttataaacaaattaacttaatcaaacatgattaaattttttgttaaaggaaggagtcaaagattttaagaataaagtttgataaacataagaaaaacttaaatcaatagattatgaacaaaccacataaacaaaacttgatatcataatttaatccaaaattttaagatttaaatttatggatcttattttcacttatgtgatattcaatcttcttattcttatttaatgtgagactcatctttatactcattctctaacattttagttaaacatgattaatttatatttcatttaaccttaaatcaagtcaattcatgaagattctgagggaaatcttgtaagctgtatcacatactgtttagaaagaaagaagggaaaaaaagataatgaaggtaactttgtttttgtgatctttttgattaggtgtgggagtgggacatgataaaatggggaagataagtgtcacctcaaactcaaagtcatggtggtagagaggggaaagggatggaagatgataatgcacccaacctccaatttctaagaccccaacccaagagcccacttgtttaatgcgcgtcgttttcccttaaaacaaacaatggacaatagggtgtggggggaaggaaccttccatgcaagccgttggatcaagatcgacggtgggtaacactcacgcgcaggagtggatcgcggaactacggataatagcttccgcaaaatgggccggcccaggaatgattggagatgaagatgagtcccacttccccctctctctttttttttttttttgttcattttaatgcacattaggagagaaaacaaatatgaattcatattttctgataccctgtaccatgctggacctagcttgactcggtcaaaagcttgtgagcggcaatgtatcatagtcccctctctattatttatatttgaggttcatttctaaattattattctcttttttaaagtaataaaattatataaacattctcaaatattataacgagtagtcctctaagtatttaaaaattatcaatttaaaacatatcaactcaaggattaaaatgatggatatttaatacttgaaggattatgtatataattttattactctaggaactaaataagagagagggtaatactaaattagttgtttattccttatttttctttggtatatatgtatatatatatgtgtgtgtttttttattatagaaattcttgtttaaattatataagattattataaataatatattttttaaaagatttaatgtaactacatatacaagactttaatataagataactaattaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactattaatcgacacgttagatgttaggcggtgtctctattattcattttgttttattgaaattgaataattcttttttagttataaaaaaaaaaggagatcaatctttctttaaagagaaaatcagaaaatatgttgattgggggaaggagcatctttctgttgtgttcaataagtgaaggaaaaacataacagccaaagacgaggtagggccgtaggggggtggtactaacccagacaaattaccgtttactataggtaggctgaatatctctcttgctacaaaaataatacagtgttgtgctgcttcttggttcagaaatcagaagtgctactactcgataaagtgaaaccagaaaaagtaaaaccaaatatgatgaactcattgactgcttaccaaatcaatgatatgcacaaactatatattgcgtctttttttttttttttctttagttaggaaagtgactgtcacacagtagtggagacattgtgcattgtttgaaattttcagtatagacataatattaaggtcttttcgttttgaaattagaaaaataattatcgtatttgtaataaaaaaaatatacgttttaatatatcttttcttctatattttttttttttgaaactgaactgtatctaattttaccttaatgttaaactgaatggtctcttattaaattaagaaaacacgaggaatttagttatgcgatatgtttggagcttctttaaaaaaataaaaaatgctgaaaggtatttttgccttttttgttgcaatgaaactatgaaaagttgatgagagatatgagaagaatgaaaagtgaaaacaggatgaagctattgggaatcattgagaattgaagtgaagtcaaaagcttgtaaaaggtgggtggtattgacattgttacttttagttcggctgactatggatgtggatcgaggcacctaggctttgaagttaaagtagccaatcctagtcaattgtaagccattggatactgaaatttcaaaggtaggcttgatccaaggaagttataggctaagacaagataacgaggaagcaattgttttatgcacccatttttgcttgatgaactcccaaaatttaatataaccccatcttacccttctctcctctcccattgcctactttcttatcctttccatcttcctcttgaccgcttcgtgccttcttgctttcgttactaatcccctatcccgcacctctacattgttggcacatccttctcatcctttagattcaggattcagagttatgatttcataattttggattgagtattctagaatgtattagtattctagaatactcaatccttaatacagacaaatgtattctaggagttagactcacttaccttactgaccatttatggtctccctatttcgactttgaattactttatcattcttcatcttgtcaacgagttctttataaatgatctttgatatgggcagtgacatcacttggactcaatgtcattcgtgtaaggattattgctataagcaatctgatccaatatttaatccattaaattcttcaacatatatgcaaaaaacttagaaatactctaggaggtaaacatttaatttttaaaacaacaaataagcttaatttatttcatttcccatggagcaagctaagatagtctcgatgacataagtccatgcgagtatgaagtccattatggcgacaaatcctttatcaagggcttctgtagcagtgatcgcctcaccctttactttgatcccatttatccctccaacaccattgacaacttctacttcgactgtggtgaaaataagagaggactctttgtccacattgctgacttttattcccttggtcgcgacaacctctcctttgtggatcatacctcgtcaaagtacaaggaaacattctcctactgcatccccaacaatgactatgtcggctttgtcacctttggcctcgacgttgcccgtgatgatgacttgaatacacccttttaatcaccgtcatcgcctgcctttcattttatggcctcgacatcaccatcgatggtaatatagtccttagccttgcctttcacgaaatcgagcacgatggattcatcatcgactttggcactgtgactacctgactctctcagacaatctatgccatgctctagttggcatactaacaatgcatgtccaattaccccaccgtcgacaagtatgacataatggatggaaagaacatggttggtaggagagaccccactaaaggtgatgagtcaggttctcgacggagattagtcatcagtaaaactggtggatactctgcaccaatatcatggtgataaaaaaaaagatgacaccacttataacagtttagactatttggaaaaaacacctaatgcaacaatttcctccatattcttcttctattagatatactaattaaacctttaaaaaatacttttactaacatccacttcaacagttccacttaactacacataaaaaaattgacaattattagttataataaatagaatacggtacaactgataaataattgattttatttaaaacattaatacatatttactcctatataaaaacttttttaatgatttttatgtttgaaaaaaaattaggccaactatatttcattttttctatgacccatatattgccaaatgaattaaaaaataaaataagattatacacacacacacacacacacacacacatatatatatatatatatatgtatatatatatatatataatcatgatcaaactaaataagaaaaagcataataattaacgtttttattatttcagaacaagatgttttcaatttatgcaacaaacgtttacacctttaaccaaactctgttcatccacacactacgatgaaagcatattctattacccgaaatatcatgcacaatctcaaggctttttctagacattcccaacatcaacatcaacaccaacatcaacaaaacctttaacccaaactaattggggtcgatggtagataaaccaaaatacgctaatttcttgtcaaattgattgggagcaaatgccaagcaatacctcgtctgattgacttggatgaatgtcacattctacaacaggtccatcatgacaccaaaaaacacaaacaccatttgggaattggaatttaaatccgctaagatcataatatgtgttcagtatttcgtgttcgcaagcagttggatagttggacatgcattgtcggtacgtcgattggagcatggcatagatggtttgggggagtcaggtgattgttggatatagggggagtaacaagaagatgaagcttgtgccttagaagaaagttttgagtttttcacatgccttgaagattgtaattcaaattaagtgtatgagagaccaatcttttgatccttgcattgcatgctcattaacatgcttacatgttttcattaaagtatcaaaactattcatgtattttaaagaaatctataagtaatgactaatgtttttggaaaaatgtaatcttattgctttaattgattacacatcggtttaatcgattatttgcttcgttttaaatctggaaaaaccttgaagaacatattaatcaattacataactcttgtaatcgattacatagtaaaaacaaaagcatgcctcactgctttaatcgattactgcaaattgtaatcgattacacaaagcttgccttacaatgaacttcactgctttaaccgattactacaaatcgtaatcgattacacaaagcttgctttacaataaaattcactgctttaatcgattacagctcggttaatcgattattctgtttgttgtaaaacccaggatgaggctttgagcactttaatcgattaagtgacaaatgaattgattacataagtcattttaattgattatttggcgtattgtaatcaattacagtctgttacaaaaagctattataaataggataaaggcttgtccgatttactaacttgaatacttcgaattttctgaatatacacaagtcttctcaaagttagaaagtaattttctaggttaactaagatcttgtcccactctttaatcttcatgggtattgaatgatttcttgggcaagagttttttaagaagttttggagagcatgttctgaaatccttttctgcaattcaactctgattggtaaaccacatgcattcatattcattggatcatcaagttgtttctctccattatctctggttgtaaattcgtttttgtattttttgttatttgaagttattgtaaagagttctttgaagcttgtgctagagtaggattctctagggaagaacatagtagtgttctctggttctagatcactaagagtctaatagagtttttagatttcttttctttgtctagggttgataaagagtgactgttgtaaagcttgtaagaactaaaatttgtaatagtggaactctaatctagtgatgattagaagaaactggatgtagcttctcttgagaagtgaaccagtataaattcttgtgttgattttcttttccttaatttctactagtcatcttgttcatttgttcttagtattattatcattactcaactagtcctgttttgagcaattgatttcttgagttgaatggtttgattgattagagacattcttggtttgaaagtgattaagatcttttaactctgattttataaataaattttaaaaagccaagtttaaaccaattcactcccctcttggttattgtgggtattcttattgttttcagtgaccacaatgttagagtcagtgattgagttgttatgctttgtttggtagaagtagatgccagggagtatatcaccgtcgatgtcgagattgtaaaatgagagaccatcgggagaggtcattaaaggggtgtagttgactccatcatcgagggaagcatcagggtcgggactaaaggtgatgtagtcgacatagtcattgttggggatgcagtaggagaaggtctcattgtactttgtgaaggcttgagacacaaaagagaggtccccgtgaccgaggcaaaaaatgccaacaaaatgcagccaaagtgtcctttgttattttcgtcgcagtcgaagtagaagtcgacgacaatttcaggggcaaaggtggggtcgaagtaaagggtgaggcaatcgctaccatataagtcctcgataaaggatcgatcaccattatgaacttggtacttgcatggacttatgtcatcaaaataagtgttccctattgcatgttaaaatgaagtcaattaagcagcttacccttttgaaataatgtgttagaaaattaatgtttatctcctggttggtttttgagtttttttgcacatctcactgaagcaatgagtaatgaagtatcatgagatggattaaatattagatcagattgctcatagcaataatccttacatggctcacattgggtccaggtgatatcacttcccatgtcaaataccatttgtaaagaactcattgacatgccaagacaaataacgagaatatagttaagagttgaaatagggagaccaagaatggtaggtaatgtacatgaatcatatttcttcaaatcggactgaatgtgcttcactcattcaaggtccttgatcaaaagtacattgtcattattacacttgacatgggagcatgacccatccatatggaccaaatgttgtttttcttctgatacttgaagtttaatagtaatagttagaaatgataataaaaataataatacatatactagtatttatttaagacatggtcgtgtagaccattaggcaattgaggcaatgacctaaggtcttcaatttttaaggcctcaagttttttttttcggttttcaataaataaattattattaatttaaattattaggtgataaattttgttataatatgatgtgttatttgctattattttaataattaagatttcaaatcttaagatatttagttgtaaatttagtattatttaaaaatttagaaaattattttacatctattttggattccatctctttctcaataaaaatgttattgaaattaatatatagtttaaatttaatgatgaatctatgattgatagagatatatgtgcacatgcgtgcatgttcatgtgcatgtgcgtgttttcattttgttttttaaaaacaaagatattaagtgaatgacataaaaaagtaatatactctattagtagtattaaattatattaaaagattttttttctttcaaaatcttacatttttaaaaaatattattgataatacttctaactattgtcattgttgaatttttgttttttaaaaaaaactaaaattattcaaatcttataaaagattaatgtatttttcactttatacattaagagtgaaatactttaattattaaaatacggtaaataattttgtagttgacaaaaaaattaaaaactaataaattataccaaattaatatttaaatgtaaattttgtcttagacttcacaatttatagacacaaccctaattgaagataagacttactaaattcaatcattttcaaccggagacatttgcaagtaagtgaaacatagaagaagtggaaagacaagaagtttaaagacaggaagaaaacaaaaattgtacaagaatacatctcttctccaatatcgcacacatatgttgtaatacaagcgaaggggaatgcccattaatatgggttatcttccttgtagttttttttgtcctcttccttgaacttatgaattaaatactcttataaaaaacacaatgtgtacattgtttactcccagccaagtctgattgcaaagaattatcaaagatccccaatgagataacctcaaagttaggggtgagcataaataatccacatgaaagttaggggtgagcataaataacccacatgaccgcaacccgcacaatctgacttgaaaataagctacttggatggatcagtttgggctttgggttaaaaagtgtaaaaaaatgattatttgagggttattctgacttgaaaatacccgtcattcaaaactttgtcatccattgatagttacacaataattagaataatttaacagaaaccaaacttgagtgatattatgttaaatgctaatgtaaggaaccaaggatatagtacttcaaggatgattctataaaaaatttagtctaaagggttacattgaaccttgacaattgacattgttctcccggggtcatgtacgtagacaaacatacttaaaaaattattggtaagtgaagtggtctctggtgcctaaaatattacctctctttgtcagacacagacatttatatagcagagcacattagcttcatttgtttgtgacaattaatgattatgattatgagaattataggcacaaagtatgacctacatagcaaaggaaccagccaaaacatacaaattttgctacagtgaaggagactttttaatctttcaaatttccagattttgttatagtgattagtagagccacttctttgttgatctgactcattggttttacgaccaatctaggattttctctatggttgttagtacttgctttacatggaattcaacaactactttgtcgtgtaatgtccatggtccaaacctaaaattgctaattacgatgttttttggcatttaatatatgatgcaaaaagaggaacaacaattgaattgaagcatgaaagttgaaacatattatagaggctgcaatattagatcctgcggcagagctacaaatgtgacatcagaaatgataagtggatggcaccatgatttagaatcagccattgaggttttcaggagtcataatttacatataatgcttaattttcctgaaatgacagatcaagaaaatcaaatattatgcatctggttcggggtgctgttggattctaatatcttcatatatcaaataacaagattggctgaccgtattcaaatttgtttgacaagcctaaagattttcgaaggtggacataccaagcagctgaaaactatgtttgacaaggctcattaacaaaaaaaatattcatgtttgaataaaaaattggctgaccgtattcaaatttgaataaaaaatttgctggggaataccaactaatcttgcaagctaggaaaatcctccaaatggcaacacccaagaaatactgaactctcttcaatacttttcttcttgtctttagcactaactgcacaaatagaaagagacaaaagtaccatgcatttaattaaacatctcacctctttgaaaaatattttaatgtaaaaaaatgccttatagaagctctcaattatccaattccttgaagggagcaaattttgtgaaccataagaatgaacagaaacatcctcctactaaggtaagaaccaaaatgaataatgttctatctgcgatgatggtctccccaggcttgttaccatcagggactttgctagattctttgattcatgtgtgcaatgaagttggcacaatggagaagttccccttggtacacacaaggaacgtttcatccatgataaggaggatcaagcttctttcttctttgtttgaagagattcaagaaacggatactccacttcccccctcttcaatactgtgtctcacagaactcttctctgtgataagaagagtcgaagttttgatccaagactgcaaggatggtagctctctttggagtctcatacagttagagttcatctccacccaattttatgtgcttgttaaggagatgggaagggcccttgatatccttcctttgagtttgcttaatgtaacatcagatattaaagaacaagtggagcttcttcacaagcaagcaaagagggctgcgttactcgttgatccgagagagcttcaccgaagagaacaacttatacaagtaatgagcaacaacagtttacaaaacaagaagagcaaggggttcgttgactttggcaaagtggaagagatattaagcagcattggtttgagaactccatcagattatgagggagaaatgtccaagttagaggctgaagctcagaaccaagccggcacaggaggactaattgttgtctccaatataaacaatctcatatctctggtgtcctattccaaatccatgatattcaaagatggagagagtgatagaaatgaagaagattgtaagcaactatcttcatttttgtataacaaagtatatgatagttcttcatcctctcagtccatgacacctaatgttcctgatgaatttcgttgtccaatttcacttgacttaatgagggaccccgtgattgtgtcatcagggcactcttatgatagaatctcaattgcacaatggataaactctggccattacacatgccccaaaagtgggcaaaggttaattcacacggctctaataccaaactatgcattgaagagccttgttcagcaatggtgccatgacaacaatgttccagtgaattgctgatttccagctgtacatggagtggccattaatggtttccagcctgttccagccgtccaccaattccagccatcaccagctgtccaccaacttccagctgtgtactagttgtctgccacaaattctccaacgtacaccattcttccccctataaatagaggtgcaaacctcacttgtaaatcatcaactagacacagagaaacaccaagagtgaattcatccaagtagtgagaattcttagtgagtgttgtgtcagtggtctgagtttgagagttgttttgttttttgagtttgtaaatctctgtaattctattcttgtgagtaatagaagctgtttttctctcaaattcgtgtgtaccaacacccaattgatccgttggcctcaacaagtggtatcagagccacgtttgaggtgttggtcgatttttcgtttttctgggttttctgagttttgcccgaaatccagttttgattgcaccattggattcgtctcgtcgaaccgagtccaacgcaacaaacggcgaattaatcggagttcaaacgagcccagaaatcgcggtcaaagtttggtcaactctgccggaagttgcagttcgtcgccggagaagacgaccggagttactgttcctcgctggaagttcgccggagaagacgaccggaattgctttttgcaccccttgacctgataagttcacccttactttttgcaccccctgttttgataagttcacccttatttttcgcacctcctattttttgataattttgaccctgaagtgtcaattttatcatttttaaccgttctggacgtaacggtaagctccattttgcaaaattcaaccttgttttggtaaattaagctactataaggtgataatgaccacagaagagtcaacatcatcttccggagccatgattatgcttactgctacaaattatacgctgtggagacctcggatggaagatctcctaagctgtaaagatttgttcgatcccatagaattgatgggtagaaatcctgactctgctaaggagttggagtggaagaaattaaatcgaaaaactattggtcagatccgtcaatggattgacaatagtgtcttccaccatgttgcacaggagacagacgcatacgccctctggaagaagttggaggacatgtaccaggccaagaccgctcggaataaagccctgttgatgaggcgtttagtcaacatgaagtgaaaaagtggaacttcagttgccgggcataccagtgagttccagagcttggtcaaccagttgtcgtctgtagagatgccacttagcgatgaagttcaggcgctattactactcagttcccttcccgatagttgggaaacgctggtagtatcactcagcaactcagcaccggatggcaaacttaccatgtctatggtaaaggatgctttattcaatgaagaggcaaggagaaatgacatgggcacagatcagacccatgcccttgtcacagaaaaccgggggaggcaacaaaggagtagtaaaagcaaatggagaggcagaagcaagagcaggggcagatccactgatggtagaaaaccaacatacaagtgccatcattgtggaattgaagggcatatgaagaagaactgctacaagtggaaggaagagcaagcccagagcagttcgcagccgaagaacaagggtggagaaacattagttactatccttggagatgtagctttttgttctacccataatgagacatgccttcacgtctcacgagaagacacagaatgggtggtagatactgcagcatcctaccacgtgactccccacaaggaatacttcacaacataccaagatggtgactttggagctgtgaagatgggaaattccagttcctctgggattgtaggaattggtgatgttctagtaaagacaagttctgggagcacaattaccttgaaggatgttcgccatgtgccagatcttcggttgaacctattgtcaggaatagctcttgacaaacagggctatgatagtcacttcagtaaaggcacatggaagttgtcaagaggcgctatgatagtcgcccgaggacatatttgtggcacactatacaagactcatgtgaagatatgcagtgacagccttaacgttgcagaaaatgaggcttcacaaaatttatggcatcagagactcggtcacatgagtgagaaagggttgtctaccctaataaagaaggagcttatcaatgtagacaaggatgctgcactagatccttgcaatcactgtctgtttggtaagcagcatagagtctcgtttaattcctcctcaacgagaagatcagagttactcagtctggtacactctgatgtttgcggtcccctagaggttgaatcactcggcggcaaccgatattttctaacattcattgatgatgcttctcgaaaagtgtgggtgtatttcttgcggacgaaagaccaggtattcgattacttcaaattgtttcatgtcatggtagaacgtgagacaggaaagaaattgaagtgtcttcgatccgacaatggaggtgaatactcttccaagcagttcaatgtctattgcagatcatatggcattcgacatgagaagacggtccctcacacccctcaacacaacggtatagctgaaagaatgaaccgaacaatcatggaacgtgttcggagcatgctcagtatggctaagctgccaaagccattctggggagaagcagtcaaagccgcctgttacttgattaaccgatctccatcagtaccattagattttgaagttccggagaaactttggtctggaaaggatccatcatactctcacttaagagtatttggatgtttggcgtacgcacacgtatccaaggagctcaggcagaagctagatgcaaggaccactccatgtattttcataggctatggagatgaagaatttggatacaggttatgggatcctaaggagaaaaaggtaatcagaagtagggacgtggtgttccatgaaagccagacaatagaagatattgaaaagcccacaatatctcagaagtcaaatgttgcagctcaggtgccagaagcagcaacagaaccattgataagaaatggtgatacagtgccagaagatataccagaagtagaaaacaatgaggaagaagatggtgttgagcagggggagccacaacccgctctgccagatgttccaggaccatcacaagacccagatgatggtggatctcctcatattccagaagttcgtagatctgaacgagatcggattccatccagaaggtatccagaatccgagtatcttctacttactgaagatggagaaccagagagtttccatgaagcagtatctcataaggataaagaaaaatggctgctagcaatgaaggatgagatggattctcttgtgaagaatcaaacttatgagatcatagaacttccaaaagggaagaaggcactgaaaaataaatgggtgttcaagctgaagaaagatggcagcggaaaagtggtgaaatacaaagcacggcttgtagtcaaaggattccaacagaaaaaggggattgattttgacgagatattttcacccgtagtcaagatgacttcaatcagagtcatacttggattggtcgcaagtatgaacttggagcttgaacagatggatgtgaagacagcttttcttcacggagatttaaaggaagaaatctacatggagcagccggaaggttttgaggtttcaggagaaaacctcgtatgcaagctaaagaaaagcttgtacggtctgaagcaggcacctaggcagtggtacaagaagtttgactcgtgcatggtgagtcaagggtacaagaaaactgcagcagatgagtgtgtctacattcagaagttttctgatggaaatttcgttgctcttctactatatgtagacgatattctgatcgtggggaaagatgcaacgaaaatcaatcagctgaagaagaaactctctaagtcttttgacatgaaagacttaggaccagctcaacaaatcttgggaatgcagattactcgagataggaagaatcagaggttatggctatctcaggagaagtatattgaacgagtacttgaacggttcaatatgaacaatgccaaacctgttagctgtccattagctaaccatttcaagttgagcaagagtttatgtccctcatccaaggaagagatcggggagatgtcatcagtaccatattcttcagctgttggaagtttaatgtatgcaatggtgtgtacgaggccagatattgctcacgcagtgggaacggtgagtcgttttctctccaatcccggaaaagagcattggaaggcggtaaaatggattctcaggtaccttaggggtacaacaaagatatgtctttgttacgggggagctgatccaatcttggaaggttttacagattcagatatggctggagatcctgatagtaggaaatctacttcaggattcatttacacttttgcaggaggagctgtctcatggcagtcaagactacagaagtgtgttgctttatccacaaccgaagcagaatatattgctgccgcagaagctggaaaagagatgttgtggttaaagcgttaccttcaagaattgggaatcaagcaaaaggagtacaaggtacattgtgatagtcagagtgctctagatttgagcaagaactcaatgtatcattcnnnnnnnnnntcagtaccatattcttcagctgttggaagtttaatgtatgcaatggtgtgtacgaggccagatattgctcacgcagtgggaacggtgagtcgttttctctccaatcccggaaaagagcattggaaggcggtaaaatggattctcaggtaccttaggggtacaacaaagatatgtctttgttacgggggagctgatccaatcttggaaggttttacagattcagatatggctggagatcctgatagtaggaaatctacttcaggattcatttacacttttgcaggaggagctgtctcatggcagtcaagactacagaagtgtgttgctttatccacaaccgaagcagaatatattgctgccgcagaagctggaaaagagatgttgtggttaaagcgttaccttcaagaattgggaatcaagcaaaaggagtacaaggtacattgtgatagtcagagtactctagatttgagcaagaactcaatgtatcattcccgaacaaaacatattgatattcgctatcattggatacgtgaagtaatggatcgacaactgttgagactaataaagatccatacaaaggagaatcctgcagacatgatgacgaaggtggtgactcgagagaagttagagttatgcagagacatagctggaatgttttctccagatacagctggagggggagaattgctgatttccagctgtacatggagtggccattaatggtttccagcctgttccagccgtccaccaattccagccatcaccagctgtccaccaacttccagctgtgtactagttgtctgccacaaattctccaacgtacaccattcttccccctataaatagaggtgcaaacctcacttgtaaatcatcaactagacacagagaaacaccaagagtgaattcatccaagtagtgagaattcttagtgagtgttgtgtcagtggtctgagtttgagagttgttttgttttttgagtttgtaaatctctgtaattctattcttgtgagtaatagaagctgtttttctctcaaattcgtgtgtaccaacacccaattgatccgttggcctcaacatgaatgagcttacaacagaaggaaacaacaagaacaacaacaagaaaaagttgaaggaggatgctatagaccatatttctgcaaacaaagccgccgcggatgctgtcaaaatgacagcagaatttctagttggaaaattggcaactggctctgctgacatccaaaggcaagctgcatatgagcttcggttacttgcaaaaaccggcatggttagccgaagcgtcatagctgaggtaggggctattccctttcttgtaacactcctaggatctcaagattcaagattccaagagcatgcagtgacagccttgttcaacctctcgatattcgacaacaacaagattttgatcatggcagcaggagcagttgatagcatagtggaagtacttgaatcaggaaagaccatggaggcaagggagaatgcagcagcatcaatatacagcttgtctatggtggatgagtgcaaagtgaaaattggaggaagaccaagggcaatacctgctttagttggactcttgaaagaaggcactccaatagggaaaagagatgctgcaagtgcactgttcaacctttcagtttacaatcctaacaaggcaagtgttgttaaagctggggcagttcctgtgctggttgagttgctgatggatgacaaggctggcataacagatgatgcacttgcagtgctcgctttgctccttggatgctctgaggggctagaagagataaggaatagtagagcattggtgccacttcttattgatcttctgagatttggatcagtgaaagggaaggaaaattcaataacccttttgctaggattgtgcaaagaagagggagaagtggtgacaaggaggctcttggcaaatccaaggagcattccttcacttcaaagcttggctgctgatggttctttgagagctaggagaaaggcagatgcagtgcttaggttcctcaataggtgctgctctcagcctcatcattctgtttagcagagtagggtgtgtaatcacatcacttcacagttgtatattttgtgaatggtatacatgaaagattggtcatcatttgttgtttgcaatttttatggtatcaaaactttggagctttgtccattgattgctgattaggaaataataatccctggattgagtagttaattatcacttgggcaaatgcttgcttctataattttttaagaatgtagattgattagcaccattgcctaactttatttacttgtctgtatgtctgtgttgcctttcgaaattttagctcaatgtgcatttggtgaattggtaaactaattcaactattccacttacctcccattctttctgtttcactgtgatatatgttgcagacatccatgtaggttgcaaatcaaaagcctggattagagtggtgcaaactggctgactttgtcatttttgtatgaaatcttaaatttataaaattaaatttaatcatattaatgttcaggcccgtgagatggagtattaaatttaataggttaaatatctttttatatctgaaaaataagataactttattttttgacgtggagtatgactaatttctttacgacaatttatttagtcataaatttgcattcataagaacatctatttcatccttgattttaatgaaattttcgtttaatttttgagtttaatagtcatgcaatattaatgtaaaacattttactttgtcaattaatccaaaatcactactaatataaattttaagatatttattataaaaattaataaaattattatatataatagattatgattggatgacaccttacaattggtgcataatttattttctcaatttattttattaaatgatgaaaagacatttataaaattttaatttttttatagtttttattgttaagtctgtgaccaatacactagcctctgagttaactgagttagacatgtactgcaaaaaaaatttgtttgaatctacaatcttcgcgttattagtactttactctaataaattaaactaatagatcaattataataaaaaataattaatattattatatataatactaaaatttctaatatatatttaatgcatatataagtttacataataaattttacaataattaattttgatctaataatatattttttatatatataaattttaattaaacctataatttttatttaaaatttgtatatgtaaaaaaatacattgttagatcaaaattaattgttataaaatttattgtataaacttatatatgtattaaatatatattagaaattttagtcttatatataataatattaatttttttaatataattgacttattaatttaattggttagagcgtcatattaataaaattaagattatatatttgaaatatgcatagaccattatttttaaattattttgtaaaacatattttttaaatacggattgacatgagtcatatgtttaatataccctttaatttatcttattttcacatgagtcatatgtttaaaccaagagtgcatagattaatttttaatgttatggtttctatttccagttttttacttattagatttcgaatttctcccttttttctaaaaaaaatatttgtcggggaagagtttatctttaattctttagggttggaatgatccaaatccgtcatgatattcccatcaattaactgtagatgtatttatttattttttgttacaatttattggcatttcagtttacgtctcttgacataatatattcataacgagatattgacaaacacttattattcttatttatattatcttatagaaagtatattgtttataaagaaatatgcaaattaaaacaaggcaacctaaatttttctttcgtctgaattccctgataaagttctacgaagcttaaaaaaaatgaaagcactttgattatgtaacttcttctcttgaaagcaaactaaatattaaacaacgtatacattttttatacatactaagctgaactaatggtaatggatttttataatgatttaattaagagacatatttttcatacaacaactaatttaattacattatgtatgtcgttcatttgacaaaattaatgatagaataattttaatttaaatttcacataatacattctcgaagaaaactaataattttaaatatgactaaactttgaatctagaatttgtctcacataagatcataaatgtcaaaatttgtgaaaatattttgaaatcagcggagtagaaacaattttctttttttttttttttattaatgttggttattgcagaggcatacagtggctccaacgtgtgtgcaacgcccaacagaacatggattcacaagcctacaacaagaagcttcaatccacactcaatgctaagatcgcttatttcgatatatatggtcaaaaacccaactaaatatggtaattaattactcactcattttaatttgcacgccttgtcacatgtttggctcgtgctaattttgttaattgataatttgtgaaggctttgcacaaactcttgaaggatgctgtgggatgcacatgacctaacttgccccgattcgtctaagtacctgttctgggatgctgtgcaccttactgaagcagggaactacgttcttgccgatagtggtcaataaaatgtgcttccataccttagtagttaggctattatgattttgattttatatacgcatttttttccttaggataattaatcagccaattggaaggatctgaataatcctcatttagggtgattatattattttttttcatggcggtttaggaaatttattttatctatagagcatgtcattttgtgtaggtacaacaattactttcttttgataatattaaaaacacttttggagctattgattggttaccttttcattaaattgtcattcttaataaaaataattctttattcagatgtgtatttttacacactactcttagaattagctgatgagaccataggagtgatgttatatcatcttattttatcctcttacaaattctcttattactccaattctaaaataatactcttcttaaattatttcacataaatcaagaaaaaataataaatagataaaaaagaatgataatttattaaaattagtcttatatcattaataatttatttataaattttgtagtctatcattaatataccattataagggatataagtgaaaaatataattaatgttacattaaaataattaaaatgataattattttagaataattttttttcttacacactaattataataagacgtatgaaatatctttagcgacttgaaaatataaaacatatttaaaaatttaccataaaaggtagtaggagactttataagaggatggagcatgagaatttataattattctttctcaaacacaatcctaatagtaatcataatttgaacgtgatttcactgccaaaaagaatagttaaaattgaaaaaaattattcctactagcatggtgtactttttatagttataaatgaatagttcaagaatcattcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatattttcaatattttttctctgcttttctttggatgaatttcaaacattaccatcatcattacttagaaacatatttatcttaaactattattattttatcttcatgtatatactcgatcatcttaatcgtctgtatatttaactctatcatttaaaaaaaatgaattttaaaaaactttttaaatcttctcacgaggaaaatggccttatgttttcaatcatcacccttgtgtactgcaaagattgaactcaattcaatatcagtatgagtaggtatatcttaaattacataaaaaaaggtagtggatactttaacaactcacatagtgatctctcaacataaagagtggtgtaaattttacaatccaagcaggccggaaaaagtaaagaattctcagttgcaatgcttctaaaattgcagtacataagtgcattattttcgaatttcatacaactttatgtgaaaatctgccgatacgttatgaatgaatgccctctcttattttgtctggatttaaggtaagaaatgaaaatatcgtgccgagacagattgcaaaaaatatttaatgcttgaagaaccacaaaaaaaaaaaatagcaaagaacacagctgctatgaaggcgctgagaagctaaacctaaacccagtcttcccacgatcatgctcaccctttctgagtatgtaaaagtagttaccctgaaacaagaaatatgttagtgaagaaatcacagaaaattttgatataacacacatatagcaaattaagaaaaggcatgatggagaataggagatgggtacaacaaataagagatttactaatcctgattaaaatgctaacctatcaattcaacagattgttcaccttaattaccttgctaaaattcaaataccaatttatagcagatagctgacaaatacatgcatacatcataagtaataagtgctcagttcaaaactaaatgagggaaaagacaaaaaaaagaggaaaactatgcaagcaacaagatttcaggattaaaaaaattatatattctcttttctttccttcatactctttaaaatgtccaaatataacaaggttaccccaaattccttcatatatattttgtcttcatcattgacatttcacttctaactccactcaatctcccaacttttggttattttttatcttctttttaattaaatactagtataaagaaattaaaacagatgctgacctctaggcggaagagtctagtaggaataactactccacatcctactgacattcgaaaggattctaagaactttcgaggagagaagtgcttatattcattctgagttaatttagcagcattcccagaaccaacaaaaacatgcccatggattccatgttctctcagccacctaattggaagatcaaaagagagatctgcaaaagcagtaacagcaacatcgccaccaatgaagtcccatccagaggaatcaacattgtcatcattagacccatctctattttgcctccgaggttcagtaggacctaatcctctagttttaaatccccataatgttgttggtcctcctagggtgcaaactggagaaaaatcaccacccaaataaaacctttctggaaggggagatggcttggttttgaatccatgcccccatggaaacacagcaccagcagatatcccaaggtttagtgctgtattgtaaaacccaaaagggacagcaaagcgaacatcaaactcctgcattagaacttagaagagttaacagagttactcaagaaaaaatagttacaaaaaacagagcaaagaaaagaaatattaaaatgtagaagagttttcagcaacaaatgttttatgagcaaacaagtcccaaccatttttgtccccaaattgtaaaacactttcgtgatagtccaaggttcactttctggcaaataagtcccagaaattgaattttgttactcaagttagtcgttgacgttagtcatccactaacactattaaccaacacatgatgtgactgccaaaacggcaaatagcatgccacatcaaatgctggttaatggaattagtggataactaatgacagagactaacttgactaacggaattcaatttcgaattcttatttgctagagttaaatctagggtctactatggcattgctttacctcatacttgtgaaatccttcatggacatttgcactgagatttcactctcacagtctcactaagggatattgaacccatcaatgaataataaggctataagcaaccaattaagttcttgtgccaatttttttatgaaaatgaaaaaataactacatggatcattcatcatatgaagcattgtcccaaggaagagtaacaagtaccatgataacaaatgacaaataaggggccatttgtttgtgctttttaaagaagaaaatatttaacttttttatagtaaatagatttttaaaagaactcaagaaaagaaagaaaaatccatttgagtgcttctcaaaatgcacagactgtattcccttctaagggaagagatcttctttgacaaagaagacgaactccttccatatataaaaaaaaataaaaataaatataaatttttaaccataattttatgcttattaactccatcaaatcattttaaatttctgatcgcaacaattttaaaattctagccactcccaagattatttcaataattcttacgccaaaatcatttaacatgagttactaagtttcatgcactacacataaatttgcttagtaacagattaattggaggaaaagaaaagcatttaattacacctgacgcagaaaccgcaagctcctgggatccagtgtaaggccaccaacatgagtggtggaaagaaaagcatatccttctgttggcctaataggagaatttctcctatcaattttaaatgtatacttcaaagatgacactaaaccatgcccaagctgcctccttatagacctggatgacatctgtgacggatctgttaaggtacgccatccaagggtgtatgctaagtcatggtgttttgtcgagattaagccaagagatgcacccaacaaccgctccttatatgaggatggctcctgccaatcttgggaaagcatggatatccgtgttacaataggagtcaaaaatcctttaactcgaggagcatacacccctacactcacctcggtcgcttggttggcaccataggccaaagaagcatcacatagatcaccataacccaacaagttcttatacttaagagcaccttcagcagtccaagaactagtctacaaaacatcacataatttccacataaataaaaattagatccccttgcccttgacgacccctaaaacctaacatgaaaaatgttaggacaaacttcaatacagttccattgctgttgtttgtgctccaattagaatttaaatttcaaattaataatccacattataaaggtttgcatcaaatgattatgtaagtgaaactccaattctgattgaaaaattgtacaaggagctgcatataagtttagtctacataggaagcgtgagaacatgagcattcaatctgtcatagacggtcaaggttagttttacttaaatctaaacttgactatctaagtaagatggaataatcagagttaattttctcacttctcacttgatacttttatatatttgcatataagtttctatacaatgcaatgcctcgaatcgaagtaaaatgtactcagttcgagtctgagaagaataaagtgtaccgagggtttggtataaacgccgaattcgccggaaactttgttatcggtttcgacaacgtcgacgatgacattggcagtgtttggaagctctcgtggtccagcctcgaggcgaaccttgcaggaatcgaagatttcgagaccctgaagcttggcaatggcgatttgcgaagcttgcataagctcctgcatgctggtggcgttctcgatgcctttcagctccgcctcaatcacccaatccttcgtcttcgtgttgccgtttatgaccacgtcgtgcactcggatcggaaccagctccgacgacaagcgccgcgtaagggtttccaccttgaaacgctgttcccgcaacttggacgctgcagattggggaattccgcgattcggttcctgaacgacgtcgtcgtcatcgttgtcttcgtcttcttcgatgtcttcgtcgtcgctaggttccacatcgtcgttggtggagtgttgagtgtgattgttagggttcagaggagttgcttcttcatcttctgtgtttgtcatgtgagactcggtcaatttgtgacacaattgagtagcgagtgtagttggcagacgccaccttctgttacaaattacagtgtttttttgaacaagagtccattacacagtctctttcgctagagcccagagatgtcttttttatttatttatttcttctgtaagaatcgaaggcaatttcaatttcatgacgcattcctcaatcactgaattagattacttgacagaattcagagatatcagatactctaattaatttagttgtttttctttttaattaaaaaatatctctatcttaaggcataaacatctattattattttttaatttgatttaaacaaacttttgagattatattttttttttcaattgttgcccataggattgcaaaatgtcaaagcatggttctaaaggtttggcttggcttgtagagcatccaaccatggtgatattagatacaggttttggttaatgaatttctaaattttattagcagaaaaaggtgttatttgtgtgacatttcaaaatgagtcagtctcattgtgtcaaagtaatatttatatttgagtaatgttatatatatattaagttttacaaaaatacataaaggaaaggaaagagataagaagagagaaaaaataagtgtatgatacaataagtgatgagataaagataaataaaaagaaaatatcaatataagaaaaatattttaaattttttatgcgtaaacaatattattctttatattttctataggttcataatgtaaatggaactcgtgtcatatttatctaagaattaattttaaatttcgtggtatatcaaataatgtttttcaagatatatacagaaatatattagtagtaatatagtgtatcattgtattgaatacagtaaagtgcatggaatgggtttgaaaaattcttaatcctccggctattttttatggtaagttttaaatatattttatacttttaagataataaatatttttactttttattcaatatttatcatcataaaagatagtaggaagattcatagatgaatatagtaagaggatttagcattactgaacgaggaaagagatataaaattaactcttggtatgtagaggtcaataaaagagcaagtaatagagttgtaatgttctgtttcatctagtttcataattgacaatcactaccctctattgtcaaaagaaagcttgcaacaacaaatgcaaaagaaagcctcactcgttaatacttgatagttttgaacttttgatcaatgcacgtgagcaggactatgattattaaactattagtttgttcggaacatatgaagtggatgagaagatttggaaatatcttgatcaagtgatatacaaaaagctattttctaggtgcatttccataggatacagttaatataagaaaaaaaaaaaaaaacacacccaaaagaacttcagcacaccattatacttcaagtaagaacttttttatgccttcacctaaggaaaaaaaggatcacaatgctaaaagctctcaaagacttttaaaaattacaatctgccacactgatttcaacgtgcttctgcagatgcaatctcaatctctgcccaccaaagtggagaaagttttggaaccgcagattcaggtgttatttttgttatctctgtgagtctctcactcacatctttcattgttggtctcttctgtggatcagggtggacacaagatgtaatcaattcagcaacttgttccagctgatcttcttggtaagatactagaattggatccactatttctttgaggggctggtccacttctaaatagtgtgatgcccagttttcaagtgaatccccatgttctactgaataaggaagacgacccgtgaccatttcaaatagtagaacacccaagctataaacattactttctggagttgctagtggcttgtccatagctcttgtctcagctgaggctatgtcattggagaaacttaaatctgagagtttggcagcgtagtcatcggtgaggtaaacggctgaacaattcagcttgattaaggccataggaggatccaattggtgcatatgttgcaagcaataagccacacccgttgcaactctaagtcttgttccccaatccaagtgctcagcctcttttactggaattcacaaaaagatctattgacagggataataattggagagcattgttgcttccaaagagaaaaggaaacatagtataatttcaaatattgtaatggcaatttcacattgaaaattacaaaattatgagcgagttttaataaataaggagtgaaacctacacagttatgtgattatcaacaaatttcagccaataattgacagtatgatagaaagagtgtgttattagcatttctccttagtgtgtagtagttactctaaaatgatacattgcttactgtgtaaatgctcaaatagtgttccgtttggggcatattcaaaaaccaacattctggtgaaaggctcctcttcttcacagtatccaataagattcacaaaattcttgggttcactttcgacaatgtatctatctgacaccatgatggttaagaagttagtaataatcaaatttcctaaattgcaattctacagttaaatttgctgggtttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttctgttatgataattgatgtaccttgcttctaaattgagcttctaaagcttttgaccaattcttggatgatgttatggaaacaaaagctacagctatttcaacgccactagacaaagttcctttgtacagtataccaatgggtgaagtaccaattacattactaaaatcttcacatgctgcttcaagatctgatctctttaacttttgcgcacctgaaaatgtaaaacactgtcatgcatgtacataggcagaaaacatacatataagcatgggaaatatagctcaaagacatgggaatgcaatcattcaaagctaaatcaattggatgaccaaagggcccaaagaaaacaagttaaataagttcctattatttgtcatgtttcaggaatcctgagtcaatatgcagtatgggatttagatcttctgtttttctaataataaaggacatggtccttcttggaaagagaaagacattttattttattttattaatataactagtagactctataactaataatgtaggtctttgcatgataaaaattatgtgctgcttatagccattgttttactcttgttaacttatagtaaaagaaatgcttagattcaccagttacaaatgccttctgaagctgtccacttagtcccatggcccaaggtctgacattagctacctttgttttacaaagatatatgccaatgcttgaaaaaataagaaacacagcaccacctacaactccagccaaaataggaactgtatgaacctttgatgaggtgcttttagttttagatagtgttccagaacctgatgtagagtgggaaggagaagaatcagaagcctttttcctatgaggagctagctttggccctggtggttttgctgagcctgatggggaagcagaaggaggagaaggtttagaattttgtagtagaccacgagtaactttaccttgatcaatatgccttcaaagaagagaaaattatgtgagtttgtttttttttagaaaaaagaaataggataagattagcctataataatagcatgagatgggcacatcttagaacacaaaatgcaagtacataagaaggcacataattcctgagttggaccacctttcaatcaattagtaacataccatgtggtggctctttctgtacaagctggcattttagcagcattagttagctgattttcatctacttgacattcagaaagcatcctcagttcatttatttcgggagataaaccaacaagaaattcattgttatccagcaaactgcaataaagaagaaactaagtacatgaagagattaaaaaaaaaagtgaaattgaactgtcttaatactatcatcatcatcatcatacaggattgctagtgagatattactccctagatcagcaggtagatgtccactgaagttgttgtatcccaaatccaaaacctccagttcttttaactctacaaatccttcagggatggtcccagagaaagagttgttccgcaaaatactgtagcatattcaccctctaattataagaatgaacgccaatatataaatcatgaagaaaaggaactacaaagtcaattccaccaagtaacaaacaattacttacatagactttatgctgacaagtttcaaaagctcaggtgccagagttcctccaaggcagagatccttcaaattccttagcaaaggaaaattttctcttcattaaaatccctcaagtttaacaatacaaacactagtgattagatttatcacaagagactaatgttcaaaaattattgtgaaaatagccactatcggtagagttgatcacttgagcatacggttttagtgttttaccaagagaaaataaagttaaaaaaaaaacttggatctcacatttgatgacacaaataaagagacagattaaaaaagcatgtatattcatcttctttacttgccctgcttgttcccataaattataccacacaattggttacaacttacaaattacaaataatcagtttctgtcaaaacagataacagaataagcacttacaagaccacaactgttccacccgagcactcaactccaaaccaatgacaagggtcaacagaagcctcatcatcaacccaatttgacaaagcaccaaaagggtcactcactattttctgcctcaacttcaaaagagcattacctgcacacacacacacacacacacacacacaaaccatgtctcagcatctatcttccaagtagccacaagattccacaaactcaaaattccaccactactagtcaagtaccttcttcattcaaagaacagcacaaacccaagttgtgaaacaagaaaaaaaccgccacaaagcaaaaagctatagaaagatccttgaaccgactgagtttcctgttcttgcccattcttgctgcaagaaacaaaccttggatggagcttaatagcccaaggaagcaaagtttgaagttttaaacatattaaaaagaagacaagttcaagaacatgtagagtggaaggagcttaagtgtgatatctaaggtgaagcaataaagcatggactggttctaagttctaagattgtcgtgagttgtgacacctgcaacgcaatgcaagagagactggtgaatggacccaaagagacttgaaagcgtgttcgctgtcgtgcagctaacaagtcataatagtaacggtggaaggagtgaaggacaacaacatattcacataacctttttaatacgttattgtgaatttgaggaaaaaaataaaccaaaaaaacttgtcatcctattaattttttccaaatacaaaacatgtttcttataaaaaatattcgagacagtatcatttaatcaaatcttattaatatatttttaaattcttaatgttaaaagtaaaagattttgccttgtctttagttaaatgatgtgatcaccacacctttcttgtttaacttaaaagatcaaattaagagttattattttctaaattttattacattactaaggactaaggagtatcattttttataggcttaattaaatatgtttttaatcatttaaatttgaatactttttttatactccaaatttagaattctttttttagtccttaaaatacacaaaacaatttctttaatctttttgttgcatagtatgactcaaacatggaacaagagatttatgacaatttttaactggcaaaatttgatttttctattctatattttaaagtatgtttttgacaataaaaaatcacgataattaagtcagtaaaaaaattaaaaaccaattaatccttttaaaaatcactttaatttttttattgacttgattctaacaatttcaaaccaccaaaaaattatactttaaaatataaaatagaaaattaaattttggcaattaaaaatgtttaaaattgtaaatctcttatttttgttttcactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtcacaaaattaaaaatatgaaagaaaaaatatatattttcctctcatatctcaaaattgtgttatttaattaactatatcagctcatttgttttggtacagaaactacctaattaatttaaccatttagttatataaatttaatcaaatatttaaataacgatatacgattaatttgttaaatatatttgacaaatgttaaaaataagatatctcttcatctcctttaataaatatatacttatctgtaaataattaagtgataaaattaattaatttgatcattaatcaagcacaagtctaggaggagtcgcatctgaagtctgaacaagtaacacgagccatataaataaaagtaaaacagcagtaaggatatcaacgaatgaatgaatggctgtgttttgatgaggattatatgatgatatgagaaatagatcgtaggttttggtgctatttaatatttatgtttattctccgatgacttgacttagctattgttatagttggtgatgatattaagacatgcctcatgtcaatgtctgtctttctcctatacttggtaaaagaccccctttatagatggcactatcaactttataaacaaacaatagtagtactttctcttaatatatttttttgttattaaaaaatataaacacagatattatagagaatatatttgagtgactagctagtttatttagactttgtttaggagagagattttagaggggaagggagggaacggaaaggtttggatagtaacatctcattgtttggaaattttaatttttgaggaaaaaaatttgaagatttttaaaactcctctgaattcttttaaatcattaaaattattgtttccccaatttggagatttttagaaggaaaagtaataaaattactatcctacaccagctacaaattcaaaattaagttttatttataaaatatagagtgtattaattttttaagtaaggataaaattgtaaaaatttcttattaattcttcatttctctctcttaatatatttttaactcccaaataaggaggaatgaacttccctcattttccttcctttccttccccttccttcccctttaggctttgtttgggagttaggaggggaaggaaaggaaagagattcaaggggaagggaggggaaggaaagggaggaaaatgagggaagttctttcctccttgtttgggagttaaaaatatattaagagagggaaattgagagttaataagatattaaatatgaaaattatataatttaaatgtaaaaatatattaaaaatatattttaatatattttagaatttgtagttggggtagaatagtaattttaattatttcctcctaaaaaccccccaaattgggggaacaacaatttttaggcttgggaggattttggaggagttttaaaaatcctcaaatgctttccctccaaaattaaaactcccaaacaaggagaaggcaccatctaaacctttcccttccctcccttcccctctaaaatcccactcccaaacaaagccttaatctctttccttcccttcccctcctaactcctaaacaaagccttagtagttgcttaatcagtctttattatataataatttgttataaaattaagtttttttaactatatttttagtcccttgcagtataaaaaaaacaactatgtttttagtcttataaatctagtaagttttagttttaatctttcaaaataatttgttaatgatttttataattttattttttaaaataattattattattatttcctgctgacatcatatgtatataagtattataaaaaaattctctctctataatatatatatatatatatatcatgcattatataaaaagtatattctaatactattttattagcttatcaaatttaaatataatatatatcattaaggaatttctatttccactcctcctaatttataatatactctcctttataattatttttactaaaatagcttggaaattgcactccgcttttttaattcttattgcctccaactaggttaaagcagagtgggataagttcagaaatttggtttggtagaattaaggataacgttcgtgcaaatgagattattagaaactaaatgcatggaatgatgcacacgttccataatcactatttctttttgttcttgtttgctatttaattttgtaggtattctagtgaccaagtttcaggtatattgctctcaacattaattaattactttattttcttggtatgtgttatttagtgatgccatccattgtttctattaggttttgtgcaagtagtgtaggtgtcaacgggttcgatgaaacttaggatttgtaaagaaaagggggcagggcgggtgggggaggggtggtgcgcaaatatattagtaattagggaaagtgaaaatagcaattcgctctcattatactttctttttaatcactaaactaaacttcaaaatttgttggcacactatatgctagaaagtgtaatatttgcaaataattctaacctgacttattacacggagaacgagtacacgtacaacttgtgctccgcttatgaagtaagccggataattttactaattcaaattggtaagtctatctgagtatgtgacagctttctctttgtacgtcttaaacaaaatattgatttaatttttctacctttacactcaaactcttatgtatatttatacttttgtgataattaaatgctacgtgtagatggataattttagtcttttaaacattttcttcgagactagttttaatatcttttatggaaaagttgttgaaatagtttatttaatataaacaattgattgatcatctacgtttagcgaactctaatgtgaagacactaaattgaatttttgatgcttgagaggggatgcgacagtttaatttttggggggaaaatggttttatgagaacttcggggatgttgtcattagataaagaatccagacacccgccaaagatgtttaaattacatacctcgctcttgacactgacataagaactactcagattgtgaccttttaattttcataatggcacataacatcattaatgtacattgatttgcataaactctttcagcataagtggctattatataaaatagttattgttataatttatagacaatgatatataactacggaatataatctatatttcaaaattaatttaaaaagttttagaatgaaaaagagccatttcatttttataaaaaaagagaggattacttacgtctatgtcatcaaaattaattggttcagacaacattgacttttctgtctttattttatagcatttttttctctaaattaacttatgtggaaaatcacatcatttcatctagaattgacttttttttagctatctaaaaactataattaacaagtatcaaagaaaaactatataggaaagctcgtttagattggtcaaacattattttaatatgcacaacttaagttttatttgtttaataggtaaacggagtttatatacttctttaagtaaaacaacactgttcgatgtactttttgcagagggagaaaattcttctatagggtagtaaatttcgtttcaaactacatacaaacagccaattaatctaacattatttttgtcataatctatcatgtttttataataagcggctcaaaatttatttaaacccaaagataattgagttgagattgaatttaaaaagaggtgtactttttagtatgtttcatgctatactttagattgaacaataccgactcaacctaaggttacataatattgtaaaaacatatatatattttttaaataaaggataaattttaaaaactttttttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgatttatttaaaaaaaaaacccaattatacatagtagtaatatattttttaatatgataatacttttatttaattgtatgtaaggtaattttcaattaaaaacaataattaaaactaccatatagtatacaagattttaaggtttttaaaaatactaaagactctgtgagttaggggttctattgggcattggccatgttttaacgagaatttattcattatttgatagccagttactcttaagttatttttttcagttgaaaatgttaaaaaaaatgatgacgagagatgtatctacacttctattatgcccaaatactattttacttttctaaaaccagccctgcatatgcattatattgcctatctttctgtactcctaacctcattccacttgaatagatacaaaaagcccaagattgttctcttcacaaacccaacaccaagcccaaacacattcatcatagtaaagcaaatgccattgagggcaaaagaaaaggtaatgtttgcattaaatccaacgtattatttttcatgtttagcatattgaatcgaattcagaataaaataattttatgactcattctggagcacagccaaggcaccaatgtacttttcctctaggaaggtttttggataaacattgtccatcctagttctgaacttcctacacactttcattctgatttaaggcgcacacacacacacaaaaaaaaaacaatataaatcaagagaagctggggtcatgttaacgtgagcgacatgagaattgagcatcaagaaatttgcgctataaaataagtgggccaagcaatcaaatcaacactccagaaaagcagggaaatacaaaatggaccagacccaaaacgaggtccaacacacacgattcccacgatctgccccaatgattattgtgcttgtgtatgagcaagaacaaaacttgaatcagaaaacggtaacaggttcgacccctttgaagaaaacttggcagcatcacccaccagacaataaatttcaaatttcgtgcccctgccagaggaacctctcacaaagatcattgtgtgctgtcagtacatggcttactccatgtgaaaatcattaatgttgaagtgccattacattacaacaaataatcaaaacctagctcctaagtcctaacaccatataataataataatacgatactatccatacactgagattctccagagactatacgattaattattaattaatatatgtaatgtagtaacataaacgaaatgaaagtgagaaagtgtttaattatcaacataaatatgatttaaatttcatcggtaagttgtctgtgagctgtaactaactgaggggtaggtagctatctggtgtggcgtgggagcacgaagaagcatgcggggcaccgaatcaagccgttggcgttgcaagaagaacagcttcggaatccgtttttctcagagaagactttgtggcttccgttgcactcatcgcacacaaggaatcggaagcctccgcaggagtcgcatgcgttctggttggagcgcgggaggcgttcgatgaggcggtggagctcgccgctctcgtggagctggcggacgtcgtcggcgccaccgacgtagacgccgccgacgaagacgcgcggcagggcgaggttgcttcggcggtcgaggacggcaaagagctcgtcgcggaagcggtcgtcgatggagacgtctcgctcgtcgacggcgacgcggaggccgcggaggatggatcggacggcgcggcagtcgtcgaaggtgcggcggacgatgcggagggaggtgaagtacacgacgacgccctggtcgaggccgggcgggagtgcggcggggacggcggcgcgtgaggcgccccaggcgcgaagcacggcggtggagatccggacgcggcggaagagcgacggagatttcggagcggccggttcgggtttttcttggaggaggctctggatgtctttgaaggaggaacaggagaagctgaaggagtgagttcgagaatgcgacggcgatgacgacggagatggtgacggcggtggagtgttgcggaaccggctgggtgagttaagccacggtggccacatgagaagtaatggtgaggaggaaagggaaaagggttttgagggtagtgactagtgaagagcggagagggtgctgatgggcatgcaaaggaaacgaaacgaaacgaaaggggggagggagagggttataaatggaaacttggttattgaaggttcaaccaggatgcatcatcatcgctaatcataaccctgcctagagaactagagaagcatgtgagtttttttttttctctcttttgactacggtttcacacatgaaaaaaaggaagatttaaaaaaaaaaatgataaataatggaagaagaagaagaagaaagagatacagaaaaagggtgtaatgtgtagggtatgaaaaaagttgttgtattttttcggttggtctattgtgcactgaagaatattttattatttttcatagtggtttattttcttagttagaaatagatcgtgttttttttaattgacaaaaaaaaattgtctcaactgtcaaggcaaaactgtaaaacaccttgccattgaatggaccatagtaaacgggtgattggagagtctgagtagttttaagtttaaattttattatttgtaaaaaaaagtttaaattttattagtattattgtaaaaagaaatagttaacatatgcactaatgtcattgttttttattgtttttaagtaattttgtttgagatatcattattatatattaaatatgaatactactttttatagtgattcaaacattgatttattgcctaaaaagaattggtttatcatattaatactaatgtcaatactttttttatattgctagacccaattcacagtactaatatatctttctattaaaaaaatactaacttcacacttattaacaaaagttaattaatatctcatggattcgaatttttttacaaatgtaaaataaggcttcatataatttctatcccatgtatataaagtggagtatttggacaatgggataagtaatttttttaggtcccactaaaaaaataagttttcgctctaaattatttttcattaaaacttgatataaaaataaaaacaaattatgtgaaatagaatctcaattaagcaaaatatatcttgaaaatgatctcatcaaatacaattaaattaatttaggtttgtttagactagttaataaacactgatgtaatgtagctttactttgttagaaaatatacaatgaagaatgttatgtcatttgagaatatatgtgagaaaaacaaagagaatataggaataacaattattagattaaagaatatttgatagtgtgtctcaattaaagatgtcaatatcatatataattggtatgtttgtctcattagaaaatgttaataaatatctttcaattttcaaatcaattttttttgtattccaaggaacttaacatcccaaattaaaaagaaaaaaaaattatgcacttataatataaaaactaatatttataattaaatgatattgtaaaacttatattgtatattgacattaaactcaaccaaaaacctttacagaaaatcggcaannnnnnnnnntaaatatattccaaataaagactgtaaaaaagaataaaatattttcaaaagtaaagaatgttgtgatatttattctatattttttaattgtttctaacttttccaacataaaaaaatatcaaaatttaagtaagtaaactttttaaaaaaattaaaattattttctaatttttgtacaaataaaatttaaacagcgtttctttgaaaaataataattactttttcattatattttttatcaataaaaataagatgtcattaaaaattacataaacagtacaataataatcaaaataaaaagcataatgtttaaatagtgatctaaaaagatactttggcaacgacaaatgatgctctgacctgagatctattgaatttgagaagtgagaagtgagtgtaaggtttcaaaaaataattggacaaacaagaaattatgagataatattaagagtagaatcggaaaaaaaaattactattactattaactaggtgttaaaaatctgaaaaactttatagaatatcgttttaaaaatgtcacaaactattttatcaaataatcctatttttcttatacaaataattttcaaataacttgaaagtgacattaagcacactcttaatcacctgaccaaatagtattagtccagccagtcctacctaacaattttccattagacattgttgaggagggacagaaaatctaacatttaatcctagcaatggctatttggattttggataatcgttgtcgtttcctaaattaaacatcaatacctttagctgataaagaaaactagctgctttaaaggagaataagcaaattagaataacatagataactgagggggaactaaaacttcatcacattcttaatcctctagagaagagaatctctccgtaggacaccttttggtcaaccttcaacgcatcgcgggaagcaagaactgtgcatgaaagaattacaataatcattagaacactttggatgtttattttaaacaaaagatagataagaggactacataataaataaataccacaaatttgatagaatagttgtgctgctgatgtccgtgtcattccagcagctaggttatgaagggattcaactggaggagctccaggtgtgtcaaaatgtgccttcatctgcctgttgatcaaatacaaggaatatgcaattattaaggtcaataaatttcttaaggttattaagattaataaatttcttaaagagactcatacgcttggatggaatcggttatcttgtcattaggatgattgatgttcacttgtgtttgagtgggtcctgtttccacgaggagttctgaaaagaaatttatgagactgatgtatgtgctataagtggataaagaatatatatcattacagcaaggctgcttctaatattagagaagccttaacaagtaatatactatataaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaacaagtaatataccttgatcaggtgtggaaccatcttcatagagtctagctaacttgaaatttacatcttcagctagtggctcaaggcctccactgctgtttgcagatgatgaataccttttacttttgaatctgttaacagttctgaagaatcagactaacattaatctaattcaacaagatcaaaactctcacctctttttgtccttgagatattcagatatgaagatggaatggacattgaaactataatgagcaattgaacactagaacaatattcaataggttataaattgaactaccttcccgaatcaaaatctgaatgtgaggcaggaccattttcagacgtcggtcttggaaaggaatgtacactgcctcctagaatatcacgtcgaagaacaattatcttgtattttcatagttatacgcatatgttagagaattcaaagatctaacaaacaaatcaataaaatataccagctttcccagatgagacctgaggagtagcttcatgccctctcaaaaggctagccgtcagttcatccatgaggatatgttcccgagccttctccattggaggtgcctggtagtctggcctactgtcaaaatcttcagaaggcttcacatttggacattttatcagaagtaagctacatttcctcctaaaataaagaaaaatcaaaccacaccaaaagatgctgcagaagactaacaaattgcatgaaatattcattttgtactcctggaggcgatgaaaatgatggttctggaggatggtgggctgaaatcctttctgcataaaattgagtttgttactttctgctaaaccttttccatataaaggttgattattttctcaataccattttaacaccccccaggcaccccagagagactctatgctgacctgaaggtgaatcatgaggtggttgaatgctcttaatccataagtcaagaataggttttggataatatatattgtctttttcagcagtaaataaatcaccaattagcacaacgggtggcagcttcatgtggttggctatctttgttgaagacataacatcagtttgctgcaacaagaagtaaaattttattgtgtatgttgttgaagatatagctggattactaattttatccgcttctcttgtcttttcttattttttatgatattaaactctcagctcagtacttttcctttaaaaaaatctggtttacaaaatatcatacatgatctgtctcttcgttgcctagctgataacatacatgaataagcatttcattcaaaaaccttggatgtaatatgcataatgaatatcaaatgaaaacctttttccttcttccccttcgtgagacaatgtcagaagcattctgaagccagtgttgatatatgtgagcaggaataatggtttgctcataatccatttcgacagccgatggttgtcctcttttccttttatttggtcctcgccttctaggctcctgttgcattgcactttggttggtcatttcttttctcatcaatcataatggtcactgtactattaaataattatggcacctgtctaggtatcatgccttcaataggttgctgaatgtctgggtgtccaggatgaaggtcttgaaacgtatcagctgcagaatagttatatgtcagcaaacaaattcatttctttctttttcctttttatattgacaatgtttagttatctctacaacatttctatactttaatatgtgcttgactctaaggaaaaaaaaaaaaactatatcttagaatattttcacagtaaataataatactgctgaaatgtagtctcataattactataataataataattcagtttctatgcaaagatgccctttacgagtcacaacttatgataccaagataaatttttactagtacgtcaccaactgaaaaaattacaattgcttaccttccactgtcatttgtcaattctgaacctcctctctagtgagaaaggtagagcaggaccaggagagatacacaggttgtatatgtaagcaatgcagtatggacactccataacttcaatccttaagctacagcctacatgtacaacactaggaatatgacgctccattactcccttacaatccttaagctatatgtacactttaagttgtagccaagctcaatcccacacaaatttccaagcttctaagttatgagtaggaatggaatttgatggagttgtcaaatcatactaaggttgggtcatgactgagtttggtctagatggtacagtactatcttccatcaaaaacccagtattgatataagctacatgagtagggtacacacaagggaaatgtggtggaagaaaaagaaatgcaattaaggtggaaggaaagacatgtatcaaaatctaccgatactttagatgacacaatgttaaaaagaaaaacaacattatttaaaaatcttaatgtttacaaatgattgttatcctaatcacctttggtgggttcgtcttgatgaggtggggagggtacaagcgtggttggaattttatctcctgaagttacatttacctgtgtttcctcatcttcttcaatatcaaacctgccacaacattcaaaaaaataaatggaatgttgcaagaaattaaaaacacgtatacaaataaaaaaggatgattgaaactaaaaacctctcaaagcgattgtacgtatccgtatgagcttggaatgtttcaaagcgttcaaataaggtaatattctctgcgtcaactgagaatgataagagttagcaaatggacacttgcatggactatacatatatatgtttagcaaactcaaggaagaaaaccttgatggagaagttctgattgatcttggtcctctcttgctccattattagtgaagggttcatccacattatcaagtcgctgcaataaacaaaagggtataatggatcaactcaaactaattggggatcaaacctagattaatttattgattagttcttttcgctttctaattccatgcagtgagaccaggtatataccatagtaaaataggcgttatgctggaatcctgttgcggtgcctgtgttggaaaactgaagggactgttcaatatctgctatgttcgtttcacctgtccctggcagagtaacagcctctttccttgaaaaaaaaaaaaaagaaggtaatacagagaacaagggaattaaatcattgaaaaaatgcatgacattactcattgagtcatgtagttatctaaaaggtaacgtatactatgcataatttgaataacaagagcaacaaaatgtgactaacttggccgtggatttggacttggggagcaatgtaggatctggagcagtctttactttccaggcttcgtttatctcaaccttttttacccataggaaagaaatgcagagaaatgtaaagaaacaagaaaccgaattcgtaggaaatgttaattaatgttgagctctataccagaaaacgggtcacgtcctctgcgagaaaacaaggtaaaattaaaaaataagtaatagaattcagaaacgtgagcactttgattttaatgctacactatcaatgaaaacaaggattcgaaagtttaccataaaggagcttcacttttctctcatagacaatcactactcctcctgaagaaacgcaacaaccattaagcagggacatggagatatcctacatttctaccaattaattgaaatggaaaatgagattcaagatcacggagcatcaaagagagcgagtgtgcacccatcagaattccagaaagtctaagagccataggaatcgatgggtttagaatctcttcgctgcacaagaaacaaaataaatataactctgcactactataagaaaaacatgcgttcaggtaagcaaccgctaccaaattttgatgatgttgagcttgtctagctttcttcggttaatcttcgcgtgcattgtcgcagccatccttcatcagggaccaagtgagaattcattcctcattttagaaataaacttccaagttaagggaaattgaaatccagaatcaccgataatgttacacggagacagaaaacaaattagaaaaagcattcgtaaattaaaacaacgatttaatttagttctacataagttcatcacattcaagtttgaagttccatgttcgatagatgctttaaagaaacgaagaaatggacaagcatggtgaccaaaattagaaaccagtgatctcagagaaaacagagtaccgttgaaatcatacttaaaacagatacaaaaacagaaataaaagcgtgaagcgaatagaaacggagttaccatatttggcctagtggtgcctttcgagcaagaagctggtgagagtaaaacatcttcaagccagtgagaaactcaactatctgtattcatcaaagtagcagagactcagtttatgttaaattcaaaaagatcaaagaaagaaagaaagaaagaagcgtttgaaaaagcagaactcactactctctattcgcttcgccttgcaaaactgtcaacccgccaaatgcaatatgtaatggcaatgcagcaagcaacaaacaaacacgccaatggtaacgaacgatgtagcaaaataagagctacccgagggtgcaccaaatcttccagtgccacaaagcatgactataacacgtgtcaatggcgtgacaatgtataatagtgtagtaggagtaggagtagtatagttttagcgcactcgtggctggctgttagggtaggctgcgcataatcaaagatttttttttctttcattctttccatcatggtgaggacaatgatgtgttacattaatatagttgtgtcttattgatttactttttatcaaatttgaattcggaaatagtttatttatttatatatgtaatgataaagttatttacaatattcttcttcctagttaaaaaggccgagttcggtgctaacacgtccgggtccactcaccccgagtcaatcaactcgtggttcgcctctcgccggtacgggttcaagactctggacatcaagctcaaggtggccttcgtgggcccactccttctcaacgacgccgtcacgcacggagatttagacgcggttaggaacttgattgaacgacagcgttccatgctcgcggatttgtcaccctcccaagccgagtcgctcctcggcgccgccaccaagctgcgcaaccaggacgacatggttcacctcctcctcgaagccggcttgtgtgagaataatcgccaaccccataatgcccctgatcaagtacacgtggcagatacagtacaaatacaaacataaatgtaagtcaatcccaagcccaaattaataggtctatcagacgattagacgtagtgtattgttgcttctctctaggattgatggaagtgtctaagatctgacatggagagttattgtaacgtccggctacttgcaggatcaacgactatccctacatatcaatataagacttttcagtgtgcattgtcctcactcacacacttcctgagaaacttcccaggaggtcacccatcccaagattccatgtactcctcccgctggtacctgccaggagccgctccttgtccgtgcctcactgcaccgacgatcactccccgcgttcgtcagcgcccgggatgttacatgcccaccagcttccgcctggttcgtcctcgaaccacaccgtactggtagagaggccttgctctgataccacttgtaacgtccgaccacttgcaggatcaacgactgtccctacataccaacacaagacttttcagtgtgctttgtcctcactcacacacttcctgagaaacttcctaggaggtcacccatcccaagattgctccaagtcaagcacgcttaactgtgaagttcttatgttataggctaccgaaaagtagatgcaccttgttggtataggtagtacctattaaatcctttaagttatcctcaactgtacagtcccatacctgcacagcctctggatccctctcgttcgggtgtgtattcgattcattcatgtaccccttccgctggtacctgccaggagccgctccttgtccgtgcctcactgcaccggcgatcactccccgcattcgtcagcgcccgggatgttacagttatcatcttttaacttacattagttggcatccatttattgttctatctcaataaaaattgatgacattttgtttatgctagtaggagtagttttttaatgcttacttcatttattgatttgctgatttttgtttgtttgttttacactagacattaccagcaattcaatggggaaagcataccagggttgttattaatgttggctctggtgttgctaactttggtggttatatgagctcaataggatcttagacctggcggtttctttgcatggtctgcaacaccagtttaccctgatgatgaaagagatcagaaagtatggaatggtttgtccttctctctttttctcttacctcaattgagtctatttatgtcattgtctctccttcctctgtagttaaaaatcctcaatctgtgttgagcacgtatgttttttaattaatttaatgcatggagatgttgaatttctgtatgacccaatcatggtgctgcaaacaaatttgctctgtcttagctcttatgtttaagaaaaatgtatttttttttcaaactgcagccatgtgctggaaggttgtggctaaggctcgtgattcttctggaattggacttgttatatacccgaagccagccttatcttgctacgagaaatgtaaagagaacaatcctcctttatgtgaaaataaagaatgggaagaatagctcatgatattttatatctctcgcgtcttatttctatgatgtttatatttccatcaattatattttctccacaataccaacatgaaagaaatgaatattgtcccttaaaaaatgccatagataatgtgcatgtattgcaagcaatgctagatattactgttttgtctaatttccacctttgcttattttgtttgcatgcttgtatttaggtatgccagactcaatagttgtctcactcctcttccggttgatggtatgggtaacctgcagagctggcccaagccttggccccagaggcttaccagtaagcaaccaaggttacctactgattcagatgccaagggcaagttcttcaaggacagcaaacgctggtctgaattagtttcagacgtttatgtgaatggtctttcaatgtcaagtgttcaaaatgtaatggacatgaatgctggttatacaaggtaaagtaattttgttattgattttctttactcactttttcctttacattctttatggtagaatatggaccattttgagggcatcggtagtatttacccatatacttgatctgtttttcagacctacgtacatatggttcaaattcaataattgcatgtcaatcttctgtgacatgtacatttacattatctgttattgcatcaacataaattgaccagtttcctccaagtttctttctttgaaactgataccgactctgttatttccagatttgccgctgctctcattgatctaccagtctgggtggtgattgtagtacctattgatgtgacagatactctgttagtggaaacgatccgaaggtgatgaatgtgtagggatcttcttaaattttgctgtgctataatagttttttgtaaaacctttttttaacggatttaaaagcatataacacagtactagttgattaacttttggacattttttaaaagagctggattagtcttgaaaattatatagcatggtcattattatttttttagaaaatagctaaattgacctttgaatagatgcgacattatagcacaagtcatattaatccctaaaaaatatagaaataatcacataagttcacgaaatgtgtattttgtgaactaaattactgcttgtttgattcaccttttgaagcaaagtttccaattatatcattttcatcacttaacattgtgcttaaaaagaatacgtgaaagttgcccatgttgaattgcattgctctattacaattgattgttaaaggagttataaggcttgctcctggtggttgaaggaagaaggaatgaggaagatgtcatgagtatcatttccaccaagaatggatccaaaaatattttataatggaggcaaaaaataccagtttgtaatattttcaaagaaaaatatcaattttaaatttttacaaaatatataatctcatggtaaaaaaaattaaattatttaagcatctaaaaattacaattggatcaatgtgtgtgtttatgtcacttatttgtttaaaagataaaataataaaattagtatcaatttattgtctcttttatctcttataattatttatatttatttgtaaaaacagtttaatattatgggggcaatatttgttttttatggggataaaaaaattatcagataagaaaaaaatattttagtgggggcaattgctcccatggaaaggtggatctgtccttgatttttactaatgaaaattaacaattaacattaatcaataaaaaaagagtattgctaagtatcatctaatatgttctaaagataaatttgatctttagtttcaaatgatagcttatgtgtttaaaaattaatttaaactcacatcccattatatataagcaaacttatgtgtttaaaattaatctaaacttacattccattatatataagcattgttctctccaaattctttttgtacaagttgttttacttctcgcatgctctgatctccttctttatccgagatgttcgagttagtctttgtttgagatatctagagtgtattgttgtgatactatgattttgatactaccaaattatcccctatttaggatgagtgagttattgtatatcccaaccctctcagtcagcatttgggagggtcctgtttcagctttatgatatttggtattttcggacgtcggtcgttggcgtcaccgttgacccgcctcatcgtatgcaacattcgatccttaaccgcttagtagttttaatcacctgcaatatgtgcccaggaatatggggataatggatgagatcgtgcataataaaccttggcgagaatatcgattgattaactattatgcgttcgtatataagcactaacacttgacctaatgagacagcttgattttgacacaaaacacttaaatattctttaactagatctttttttctctaagacacaatccaactataaagacacttatcagatagataactttcctaaaccatttgttatttagaactgccattgatacaaagtcttttttcatatatgcataaaacacaaacatcacacatgcattgcacattgaaatgaaaatacttttaattcaatataaacaactatacatctgaattttatgaaaattgatgaaccagccacatcaataataatatcaaggcaatcataataattaagataaatatgttttaattctttaatttgtggttaaaattgaaattagcccaatagccttaaaaatgattttagtttttttatttttttataattaatgaatttcattcctagtctaacattttaagttctgtaaaaagagatagaattttctgattataaaattatgaaactcaaaatcgtcattttaaaattaaaaaaaatactaaaaagagataaaattttataattacaacccattagcatcagcctgatatatatgaggtcatggattcaaatgttagtgtgaccattatacaatgtataaaataataacaattttaacagaatatctcaaagaaaaaaacaattttaacagaaatttgactaacacacgttttaccctaataattacaataagtaataatcctagcgtcagttgtttgttggtgtccatttttcttatcctttttggtcagattcctcctgcataaatcagggtttggtcttcggcttttgcagaatgtgagacacgacacgacattgttctaacgttgacattaaaaccttaacatgttcggagacagcgtttaaccacagtaatctcacaattaaagtcaccataaatctaattttctttaattaaaatttatgttttactatataatagcacgaaccttcgttgtatttcgtaagatcctgctaaacaaaacaaagcacaacgctgccattgtcagtgtcaacgcgtcggttcgaaagtttgagaacctaggattgagttgaagctgcgttctgaatacagaatctgaccaccaaagtacagagtctttaggatccgaaggacaaccacaagatccagttattccttcttcctcgtaaacccgtgtgtatctctatctttgtctcccttgagcagagtgaaaaaacaaaatggcaattttagctgaagacttcttcaaggagagaaaataccctttcattctcactctcttaatcttgctcatttgcgtcacgctcttcctcttcagcttcaaccacaccacctcaaacgctgttgctttctattctgttatccaagagaaaccaccccttaacccttcccaagcatctgctgattatactgcaaatccaaaagagcaagagcttccaccaaacatgaccaatgtgagcttcgattggaagctatgtgaggaaccgcagaatattgattttattccctgtttggataattttaaggcgattaaggctcttaagtcgagaaggcacatggagcacagggaaaggcattgtcctgagacaagtctgcattgtttgcttccccttcccaaaggctataaagccccagttccatggcccaagagcagggacaaggtgagattgatgagaattgaataggttttgctttatgatatgtcacataccaatttcttcttacatacttatgaaaatggtgtgttgattgttattagttaagtattctgagttttacttttatctagtcttgaaatcagtggagaaggaaaccttttatttttttatttttttcagatttggtatgataacgtcccttattcaaagctggtggagtacaagaaagaccaacactgggtagtgaagtctgggaaatatctggtctttccaggtggcggtactcagttcaaagatggggttgatcattatattaagttcatagagaaggtatgctgtcatctggattcacataatttagtaccataattatgatacacgctttaagcctttaatcttttattctccatgtgactgttatagttactgagaaactgtaatcaactactaaaaaagagccgaaaaatgaaaataaaaataaaataaaattcggaggacatggagagtactgagaaggaacctgactactgtttggatcttgcttggcctacatattgatattatatgaacacatcaaaaaagctcagggattataattaggaatgttaggcaggagcagtaggtatatattctgatagaatactgaggctgaatttttttttttgcttagtgctgttagacgtagtgctttgttgcttctctctaggattgatggaagtgtctaagatctcagataaagagttggcattttttaacttacagtagttggcatccatttattgttttatccaataaaaaatgatgacattttgttaaattttattttaatgagtgccaaacaatgtttcattttgatttatgtatgacttaaaccagtacattacatatgttatactcgaaggactaatttttgaatgcttacttcatcttgtggtttgctgattatttttttttgttttttgttttacactagacattacctgcaattaagtggggaaagcatatcagggttgttctagatgttggctgtggtgttgctagctttggtggctatctgctggacaaaaatgttattactatgtcatttgccccaaaagatgaacatgaagctcagatacaatttgctttggaacgaggaattccggcaactctttctgtcattggaacacaaaagttgacttttcccgataatgggtttgatttgatccattgtgcgcgatgcagggttcactgggatgcagatggtacttatcttcttttcttgtttccatcaagatggggttctataattgccttccatgttccatttatattgatctctgagaaatgtttattcacaaatctgatcacaactttaggtgggaagcccttatatgagctcaataggattcttagaccaggcggtttctttgcatggtctgcaacaccagtttaccgtgatgatgaaagagatcagaaagtatggaatggtttgtctttctcttttactctcacctcaaccctgtctatttatgtcaatgtctctccttcctttgtagttaaaaatctttcatctgtgttgagaatgtatcttactgaatacatgaagatgttgaatttctgtatgaccctgtcataatgctccaaacaaatttgttctgtcttcttatgtttaagaaaaataatttctttttcaaactgcagccatggtggatataacaaaatccatgtgctggaaggttgtggctaagggtcgtgattcatctggaattggacttgttatataccaaaagccaacctcatcttcttgctatgagaaacgtgaagagaagaatcctcctttatgtgaaaataaggatggcaagaatagctcatggtattttgtctcttctcgggattttatttatatgatgtttatatttcctcctgtttatactttctccacaatgcctgaaagaaatgaatattgtccctacaaaaaggccatagaaaatgtgcatggaccatggaaagcaatgctagatattacaatgtttagtctaatttctaccttcgcttattttctttgcatgcttatatttaggtatgccagactggatagttgtcttactcctcttccggtggatggtatgggtaacctgcagagctggcccaagccttggccccagaggcttaccagtaagccacctagcttacctactgattcagatgccaaggacaagttcttcaaagacagcaaacgctggtctgaattagtttcagacttttatatgaatggtctttcaataaagtggtcaagtgttcgaaatgtaatggacatgaatgcgggttatgcagggtaaagtaattttgttaattttttttgctcttttcccttttattatattctttatagtagaatatgggcaattttgagggcattggtagtatttactcatatacttgatctgtctttcagacctacatatgaatcaataatggcatgtcaatcgtctgtggcattcaataaattggctggcttcctccaagcaactttgaaactgataccaagtctgttatttgcagatttgccacagctctcattgacctaccagtctgggtgatgaatgtagtaccgattgatgtgccagatactctttctattataatggacagagggttaataggaatgtatcatgattggtgcgagtcctttaacacctatcctcgcacatacgatcttcttcattctagctttcttttcaaatatcttgagcaaaggtatgcttattgaggaaactaatacctataagatcacgtgatttctccttttatttattgttttagaactctctcgacttacttctacacgtagcataggtatttgttaagagacatatgaatctgataatgaacatttttttggtcagatgtgacattctagatgtggctgtggagattgatcgcatattgagaccaaatggatatcttgtggttcaagattctatggaaatacttaacaagctcattccaatcttgcgttcacttcactggtctgtaacgttgcatcaaaatcagtttcttgtaggtagaaaaggtttatggcgtcctacgagctcttgaaactgaatgtatatcaggttaataaaaatgacgtattcttcaatcacccatgtatcagtatattctggataaaaattaggtgtaaaaagaatgaattttaagaaaggaatatttattcgacaaggaaatcttgtctgagtgtgaagtatgttaacgagacatttattagaaatgttagttttttttctacaaatgttaattttttatttttattaaaaatgttagtagggggatttgaactcttcacttctctctcttctcttatatcttcttttttaatcattggactaatcttatatctcgtgaaaacttatgaatgatgcatttacctttaccataacttctgcatgcaatagttaaaagtagtttcgttcatgcacttgttagcacaagaaccaatatagcatgcagaacatgttacgaaaatgtcaatttttttactctattctttgttttcaaaagtatggatattttttttaaaaagcaaaataatttcattgatcaaaagtgaaagcttaacctccaaaacacaagccgtgttttaaagaacagctcctccccaagataatacagcttccagaagcttcaaagtttggatataaaatagtgaaaaacaaagtaaaactagaaaaatgaaaatagattttcattatttattttactaaatttattgtctattttcattttcttttttcattatttttgtacaaacttttgagaaatgagaaaaaagtaaaaatacaaatagattttcttaagccaacaatccttaggcttttgttatggacttgcatgaatggcctctaaggccacgaaaagcataattcttgaagctgaaaattgctcgtctgcaagctctactctgctacgagccatacatttatgatatgatctttgtttactaaccgtgggttcagtagcttgtgccttccttcagtgtctactgtctagatccaggcacagtggcacgtatggaaacaatacatacattatgcagattcaaaagatactatcatacagattccttcccctagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaacctatgcaggaaactacataataaatagatgtacggaaaaaagaaactacaaagaattttcacaattcacagacaaaagttgaattgtccgcaacgaccctgccattagtcgcagcaacattccttgagtagcaagtgaacctatcaaaataactgtaattctgggaggtgcttgcttgacccgaaacaacagagtgacccttaacctcgatccacccctttgaattctgctcattactaatcgatttgacgaagcacccactcacatgcttctcctttagagtgtgagaaagatcagtgacaagcctataagtcccatcctgaaactgcttagtgtttgtgacaacccttaaagggtacctcctcctaaccttcaacctagtaatcgattcgccttttccatcgatcaccttaaccttcttcttggccttgaacttctgcttaacggtcttgatactcccgttgtgttggaactttatggagttcttaaacgagaagccctgagaaacagtggtggtgatgttgcccacactagtcataacccaccctgtgatctgcgtttccttctctgcgtccacaccaaaggccccatcaagccctttaaagtcctcttgccgttcgattgaagtttcaggactgtgatgaaccacagggtttgcatgaaccaccgtggattcatgatccaaccaaagatgcaaatttgcgttcagaagccagtaagagattcccttcaccaccccaattccaaagacgtgctctttcccgtccaaaaccttccccaaaaacggcgtcaaatcgatgtcatatgagggaaggtcaaaggccccaatcgccaccattggttcccagaacagagggtttatcccgccggcgaagatcaccggaaacggaatctcccatccaacaacctggccgtcgatcgtcacgtacacttccctgtacgcgccgttaccacgctccgtttctaaaccgttcgccgcgatgtacgaattcggcgggttggagtaccaaaactcgtcgtttccgtggaaagaaacgtataactcaagcaccgcgcggtaagtgttcctcggaattcgaattctccgggaaccagaacctttttcttcctccaatttgaaccagaaccctcgccgtccgtcgtcggagatcggaataatcaaatcagccggcgattcgttcacgcctctggagcccggttcctgaacaagagatcgagatcgtgatctcgattgaattggatcaaaattgagtgcctcggggcacgggacaaacggaaccctaacgggagctctaacggcgtacttgttgtagaacaaaagagtgacggtgacgtggtagacaccggtgaatttgttattgacaatgttttcgagcatcatggtgaggtcttggttgggcttggcgaggagggcggagtatttggtgacgtccttgtggacgttccagaagatgccggcggggctgggctcggcggtgctggtgcggaggatctcggcgccggcgagccagatggcggcaatgcggtcgtactgctcgcccttgcaccgcgcgtggaagtggaggaccacccgagaccacggtgccccgcaccgcgggggcggtgtgtaagaggtggtgtacggtggagaatcgatggtgttggcgaaggcgtggtggattattcggtgggtgcatgaaggtgttatgggttcgtgtgagtttggagggtaactcacttcgaagtattcttggtgagaaccactaaggggtttgcgtctcatgaaatggtctggttgggactctgataaggttgtcaccaagaggaagagtatggagcagaggaaggtggtggtcatcttgttgtttgttgtgttgtgttgaacaatggcacactgtaacactttttttttttcaataactaaataactaacctcttaagatgattcatggttaggaaatcatattcaaacgtgaaatgaagctgaattcgggttaaaaccctggagaactttggatactgggtagattgcttaatttacaatttgattaaaaatggcattatatatataatggagttcggtactacaaaataaggaaatttcttggtcgtgtttttcttatcagcatcctacccaaagtaaactccgcgtgcacttcttccattccattgcaagtgttgccacatcaaaaataacaaactaaacttcaattatgaaaattgaccttatttaattgctctacttttatgtcataataatagtaaagtgataaagatgatttttattattttttgggccaaaaaatgtagaagagtgggtaaattttatacactcaaaggtaattcaggaaaactgtgaaagtgccaatgaccttaacaaacagataaaacagagacaatagtttgagtgtaacgtattggacacacatttccaattccagagatctttttagtcgctcgtgtataacgaaagcatattgacactgtcatacaatatattcaaattagagattgaaaagattaaccaccacccgccccaaaataataaaggttgtgctttccatttgcttctccactctaccaaaaagatttggtcaatctgtgatctcaaaaccctggttcttctacacatcaatgtcccctattcttatcttcttcctcacaatcttcaccaccacttaccaccgcattgtcttggcatagctttgtcatgtgttcggcaagaaaaatatcaccatgttcactcacctgaatcacaatgtagtgccaaaaccatcaaatcaaccaaaaaaaaaagaagtataattctactctaaatctgcactatattaaaagatagaagaaagcatggcagatggagtattagtgtattggcaaaacatatagagaatgtcgtaaaatgatatatattagaatttagaaaaccaaaattcagtcaaatatagaaaatattgacaccctgctcttggcgcatccttcacaagtttacccttgtcagttgtgttgttctattgacgcaaacagaagcaacattgttgacaacaagtattccttgcaactgtccagaccatatcaaaaagttactgcttacacttttagatgcaattctacaagactacaactgccttacttctacttgatagtggataagatatgagatttaggtgggaaagagaaaggagggaagaagcacaaaacataacagaatgatagagagagacagacatcaaagaactgagtattccaatctttctaaaatacaacagtcatgctttagttttaggcagctacccaacatatatcaaaatcctaactaacagtacctgactaactaacattattttcttgtttatttttacataacaagatactggatattgtctagtctgaagtatctactactctactgtcttaacagttggattgtcagaagggagatatcttctaataacaagtgcaattacaatctctgcaaaggtggcatttgcttaagtaaccacaacttttaaagttatcagcatagcctgcataggacatgaatgatatattttttggtctagtacaaataaatattcagtagcagataccaagagtttacctaccatatcaaccacatcctccatgttagtaaccgagtgagagatagctgtaggttgggggtacatctgatacttgattagttggtaggataaacagacacctttaagtagtattcagaaacacaaacatccatatgtttgacttctgaaatgtatacccccttagattttttactttgatcacttttgaaaaccagcaaatactactaatagtaatttgtaacacaataattaagggatataaaaggcaaatcaggaacctctaagtacaaagtgcactttagacagtagtagagtacaagggggggtgtctattaccactccaagatgtctattgttacttctattcaagtaatttttgtctaaaatactcttttcatctttgttaaatgttaatcaaattaataataagggtatttaaatgaaaaattgatagataggagtggcaacagacacatgaaaggggcaatggacactcccaaaacaagttataaattctcattagaaaatccagagtaaattcccaaaagtctatgactttgtttatttatccatgtgcttgcattagatgttataaaaatgtttttttctgaatgcaagatgttataaagagctaaagcagtccgatagaagtcagtggctttgattgtttaatggagctgacaccacctaataggatagttagtagtagcacttgtatttattttcccatcaatttccgccaagttagggtttagaggggaaaatgatcataaaaaaatcgcccaccgtggggctcgaacccacgaccacaaggttaagagccttgcgctctaccaactgagctagacgggcttcttataataaattttttattatttgtaatactatttatgtttcacttgaagatatagtttaacggatgtagttcttttgggtaaaggaataaaatttttattttattttatatatcttcattttttttcaatgtttttatgtttcatattgttggagagaaaatcctttgcacacacactcacatatatgaacaagagaataaatttcaaaaaaaacttgtatatttttttctcttgcatttacacatgtacctcttatatagtgttttttatctcaaagttaattacaatataaatatcaaaattaattatcctttaataatctaattaattcctaattgtgttctacttatatttggattaaaactcaacactcatacttaatccaaatcattacaagatacaatttccaacttccttctcagttttacaaatctattaggcctaattgtcttagttagtatgtcagctgaatttctgttaagcgtatgtcacttcaagttttccattattcacatacgtccttaggaaatgaaatatgattttaatgtacttatttttcccatgtgagactggatttttagttaaattgatggctgatttgttatcaattatcaatttaatgtgtttttctacttcaaatttcaattcatctagcaatgaatttagccaaatagtttggcaagcagcatatgagcttgctatatattcaacctcacaagaagaaaagaccaccataggttatttcttagaacaaactaaatgttgacaactaaacacgagggttgtgggacttagtccaacaccttaaagcacgagttgacgacaaccatgcaccacctctttcaagagaattcacgtcaagaaattggagcacctataaacttgaacaaatatccaatagtgagaatagtatatataacaattgtcttgattaaatgaccatttttttacaacggataagaggtatttaaaatttcttatttgatacttaactaattttcatctcatcgaattagactatttttgataaaataataccttagatgtgactttgtgtctaaatgaaggatttttctattaaaattttaataacaaagaaaaagtcactagcaatggcctactatacataataatgtcaatctcaccaattttacaattttgaaagaataaaaaccaaaataacctaaataagaaatacttaatgtagtttaattattaaatttgtttgctctaaaataagggtttttttccgaaagaataaaataagggttgaatctagacaataaaacatttttataattattcattaaaaaaagttgcaattaaaatttgaatttcattatttattatacatatacacatattttttgacaattttaattactaatttgaaaacaataatcataaacatatacttatcctaaaccaaatgataacattgggaaaaactgtattaatgaaagcgtaatctcattattggtataggccccatagttatagtttatgactcgaatgtgatcaatttaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaacactcaaatgtgactcaaatgggcatttgtcttctgacaaagaaaaggaatatgggcctttaaggaccatgatccagcacttctaaggattagggtttcttttcatcaacctctcaccttaagtgccgcagcaactcattctgtttcttcattttggtataactttagccgaggtccagaggagtactagctaggttcacaatttcaaaatggttcgtattcttacctttcttctgattttgatgcattctcaagtttatcttcataataggtttcgatcttcatcgtcctttgagcattttactccaattaaatcttcattttttcatgaaatagcgcttggttttctgcaatcagagtgtcactatgtgtttacgcttcagatcacatgcttcaattcacgatatcatgactatttgtttgataatgaattcgtgcctttgaagagtctacatttggattctttagatttcactctgtgaaggatgcactgcattttttggatttagctggactaaacttgtgttttggatataatttgttctttctgttttttttatccatctcgcggatccattgatactaccctagggttttgttcatttaatgttagacttgctgtttggatttttttttaatttgtgtttagagttttaaacttttgtgcttatgactgttacaggctagggggctaaagaagcatttgaaaaggctcaatgctcctaagcattggatgcttgacaaactgggtggtgcatttgtaagtggaaatttaatcattttttaaccagttttgaagggtattattttaaagactgatgaacctttttcatcctgtataggcgcctaaaccctcatctggaccacacaaatcgagggagtgcctccccctcattcttatcctgcgaaaccggctgaagtatgctctgacataccgtgaagtcattgctattctgatgcagcgacatgttcttgtcgatggcaaagtcaggactgacaagacttaccctgccggtttcatgggtatgtttgcagcttgtcaatttttagaataactgcctgtttcatgttatgcagccaaaatatgttacagtatgagggggtaataatatgctaaagttacttattgtttattgagcttgactaattctgaatctgatgtttttaacaaactctcttgaagtctaggtagctggatattttatatatatatatatatatatatatatatatatccaggactttgaatggaaagttagatattaactgattctcagcttttcatgttctaagaatatagtcttttcctctgtgagaattacagacattgtaaatgttaacccttatttctaacattctccagtggcgtgtgaattgactatggtaaaatgtgagcttgaatttagctaaccaaattagttgcagaaacaatttttggctgtcaggctatacttacctcctgtccgaactccggattagtcaggttgtcccattcccccgatgtattggagggttaagacaaaaaataatagttgcagaagcttccaccaggctctctcccccctctcccccgccgaaaactctttttgtctgtcccaatatgtttctatagttatattgatttagcccgaggaatgatttcttttttaattttatctctatacagatgttgtttcaatcccaaaaacaaatgagaacttccgcctgctctatgacactaaaggccgattccgtcttcattctgtcagggatgatgaggccaaggtactttttatatggtttatattgaatattgtgattcatttgcagcctaggtgctattatactattattatgtaataatacagtatataattgactgtagctttgctgtgtttagttatcttgtatggaggctaacaaatgtgttgatgctattgaaccttttaaatgtcaatttcaggacttgtatagttttttattttattttattttggagttacaatttttcctacttaatggttatggtttaacatatattctttatatgttgtgtaaatggcagttcaagctctgcaaggttaggtcagtgcagtttggccagaaaggtatcccatacctaaacacctatgatggtcgcaccatccgttacccagaccctctcatcagggccaatgacaccgttaagctggatctggaggaaaacaagattgtcgattttatcaaatttgatgttgggaatgtagttatggtaacaggtggaagaaacagggggcgtgttggagtgatcaagaacagggagaagcataagggtagcttcgagacaattcacgtgcaggattccactgggcacgaatttgctactcgtatgggcaatgtgttcactattggcaaggggacaaagccatggatatcactgcccaagggtaagggtattaagctatcaatcattgaagaagctaggaaaaggattgccgcccagcaagcaactgctgcctaaaccccttttggatgaatagacttgagtgcttggtggttttattcaatgtttttgttttctaatttcttttgtctaagtttttaatcgttgaattttgactcttgcactatacaactttattgtggctgtgttatcttcatgaagtaatctttctattccctagttttttacttggtttttggtcgtcgtacaaaatcactgaatcaattgcaccataacaaaatgccgtgccgcagctgtagtaagatggtatttagggatgtttacgggtacgggtcatccgtaaattcgaactgtttgggttgggtcatttacgtgtttgggtcaaaatcgaattgaaccaatcaaaatcgatcatgtatggattgggtcatgggtttagatttatagatctgttgactcgttaacccgatctgtgaactcgtaataataatataaattttattatttatatatatatatatatatattaaaaattactttttttctctcgtttagcatatgattcaattaatttattttttttgtaaaaaatttaatagaaacaacattttatttgttattgtatttggacaaaataattaataattttaggcagtaataacattgtagtacaataaattttttatagttttggttttttaactcaatcagaaactgattcagcaatatgtactagaacatctcattttttattctagtagcaattaagttaattctagtacattggcttcaaacatgtctcataacataatgatgataaaggtgataaggatgatgattgagatgatgaatttagaatgaaaatcaagaaaaaacagggtgtggtgcaaaaaaatgagttagataggtatttggaggatgatgttgaaactgatcaccttgagtttgacattttgaattggtggaaattgaaggcatccaaatattatattttttcctatatggttagagatatattgatcattcttgtatctactttattatctgagtctgcatttagtatagggggtaaaattctatattcatttcgtagttccttgagtcttaatactgttgaagctctcacttgtgtccaaaattggattagatctactaagcaaaatcttaatgacttgcaagttaaaataaatgaagcggaaaagattgaatcaggtgtgtaatcctttattttattttttatatttgtataaaatatcaattaatttttgcgctaacgatggggttgtgtttaaatttttagagttgttttgcttgactttaaatattgctaatattaggtctccaagtattgaaactgcaagtgttggaacttcttaatgtattactttcaggtatattattatttgtttcacctttgttttcatattttgtttaccgtgtttataatattaatgaatcatattttattcatttgtttgtttcagcaaatctagttacaacaaatttggttataacaaagcttagtttgtaagaaatagttgtgatttagactattatagtaaatcttattcaagaatcttttgttttaatttatattataagtctattttagaatattatgttgatgatattaaatgaatcaattttactactttcatacatttgataatattgtgttgattgtattggatatttgaaagaatcatgatataaaatagtagttctatgaaaaaaaattaaatggataaccagttgaaccgaaccgaaccgatcatgaacgggttgggttgggttgggttttaattatttttttttctaaaaatcaaaccaaatcgaacctatcaaatttgattgggttgagtcctaaatttggtcaaaactgatccaaactgacccacgaatacccgtaatggtattgcttgctattgaagagaatatggatgtttatttgcgtgttttagtaatgattcaatgcacctcattgtttgaaggagttcttttaaattgttgatttgttgtccgacttaaaaggaaatgctattaacacatttttaacatattcttttgatttgaacacattctcgacatttgcttttttagtccctctccttgtatgtgtcaaactaaaaatattgaatatgcaatttcagtcgacctttggttgttagaatttgatttttaaaattctaaaattaaattctggtggtcaaccaccataatttttaatttttgtgtaagccgcaataaattgtgaataagcatttcataagtttgaatgattaagaaaaataattttaatttgagggattaaaaatatttataataagaaacgaaaagcatatttaagtgatttagcctcctcaaatatctaatgaacgaatacacgctaataagtttataataggcacttccactattgtttcctacattgtcaatgtattatggaaagctaattcaaaatataacgggataatgtagaatgcaatagtgggagtgtacagcatgaagggtttttgtccctaatattcattaagaaaaagtgcagaggagttgggtctcgttagttaattttgggtcaaactcatttgggtcttgagttacttcaaatgtagtcactcaaaaattaaggttaaaattgaaattaaaaaagtaaaaaataaacagcaccgtcaatattgcccttataaaaaaatttccaatactacacaatttacacaacaaaaaataaataatctcaataaaataataaaaatgaaaattgaatttaattatataattgtgatgaacataaaaaacatagatatcctgtctaatcagccaactgcaaccttttattatcattattataaaaactgttatattataaatgaattatattggtgtaattttgataattattatacaattttataattttcaactgaataatattttcttaaaatttactattgattaaaagttcttttcacttaccatatatgtaaaatttcatattattctaaaattatttattatcttatttatataaattaaaattgacgtaatataaacatttcaaaatatactaaaatatggatcatttgattatcttattgttcaattttgataaaatttggcacaaataattttggtaacatgtagatataatttaacggttgaattaataaaaatcacattttatatcaagttataaaaatgatgtaatagttattaaagttacactgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaataaagaaaatatttgcactcaaaagtaataaatgctttgactttatcatccttatctctttagtaatattttttctaaaaaaaatgttcccatttatttcatatatatatatatataaaggattgtaggttatgaacctgattcctgtgagtcaaccttggctgatacacctatttattataactttgcaatttatgctcttaatcaccaaatatcgttgcttagccttattgcatccctagccatagataaacttattatttagttatgggtcaacttgcaatgtaaatgcatgcatatttgctggtgtagggatttctatttgttttatcatcttctatgatgagaagggagagtaattaataaaataaaataaaagtttcctgctatttatttttggggtgttacaccatcatcttttcttgtttatgtaccacatgtttattgagataggttttgccttctttttttctgaatacccagttctaaatagaggaatgtttaggaaagactgagccacatgtgttttgtctaatttgcctttgcaatggtgaacaaacaccatctctcacaacttccatgagcagcaaccatttgaatcactgagattgcaccatgaccaaaaccgtagctagcactttcttgccttccaggcttccagcccttgagtcctgcacactgagacgcaccatggctcagattccacacgacaaaaacatgagccaatcaccaaagttcaaggagtaacttattatgcttcactcatttacggagcaaaacattaaactatttaaaaatatttaaataaaagaaacatgtttatttctttacaaggagggaaataataatcacttgagtcacttctgtatgccttgaaagagttagattccgactatcaattaagaaaatattaaataaaataatatttgcattttaaagtaataaccttatttctaaaataatatcattataatatcgaattttcttgcaatgttgcgtggacaaaagtaattaattactttttaaaaaaaataatcaatatattaattatttcattgaaaataatgatagtgatgacaatgacaaaaataataaataaagctgatgacgcttgttagaagtaatggtgataatagtaatgataatgatgatagtaaagatcaaaatggtattattttatgtgttgaaggagagattataagaagtgaatctattaaataaataagaaatgaataattttttatttgaaaaaatcattaccaattaatatatttatcttttttataaaaacaagtaataaattactctattgtgtacaacattggacacgttagatagaccattattataatttagacaaaaaaatgttttcatttatttcatataaaggagtgaatataatattttctcatttcaaggattttattaggaatattgtaaaaatatttccttaaatattagatatataatataataaaatgtaattaaatattttcttattttaagggtcttgttaatgaacaccgtaacaatatttcctttaatattagagtaacatgtaattaacgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaagaatcaaattagtattttttttattttacaatttagcattaattcgtacgtccttccgttttgatctatacaaatacaaattgaaattcatattgaaagtataatatagaatataatgaattatgtaatgaatcaccataaaaggaaataattatgtaacgtgagcaatgctataaagaattcaacaaccttacgtctcgtacggaatggtttctctttttttttttttaaaaaaaataatttaagaatcaaaattaattttaattttgagtttcaatttattctttgtttttatttttttttaaaatgttacaaattgaagataaataaaatgagtcaaccattttatcttatatcgttctattatgaaataatgatggtgacgagataactggatgagaatggtgatgataacactggtggtttaggtggtggggtggaataatggaggcaacggtggtggtgaaatggtgatgatcatgatagtagtaatgaaatggtgatgatcgagttttaaaatccagatagacccaactagtcgaactggtttgactgcgatcgaaggtctagtcgagtcgagttgcatatcggatcgatcatgcattgatgaacatggtgcaacttggaatgacccgaccaactttgtggttaaatcgatgacccacttactagatcgggtctcccccaagggaggaaacatgctcgatcatccgggtcaattaagattgggtataaagttataacttttttttaataaagaacaggtcatgtaggtcagttagtgacctcataccttgactaagtcaattactggttcagattttaaaatttgggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatagtgtcaatggtgacaatagtagcgatggaatggtggcggcgacggcaacagtgtggtggtagtggcgatagtagtgctagaatggtggtggtggggtggaatagtggtagcggtggtgataacaacaatggaggtgacaaaacggtgccaacaacgacagcgatggaatgatgcgatggtggtggaggcaacaaaggcgaggtgcgatagcaattgttgtggaatggtggagacaatagtagtggtggtgacagcgatgtcgtggtgctaaaggcaacaacaacagggtgtggtagcaatggcgatgatcgtggtgaaatggtggtgatatagtgatggtggttagaatgtgtattttaaaactaaaaatcaaattcacaaaatcttttttttcttgattttgataatgaatatgaaactgttttgaaattgagttaaaaatcaattcaacctcctttttggcaaacatattttgttttgaaaatcgaaaatcagaaactcgcaaccacatcgaaagaggccttaaagaattaatttactccctctcattgcaaccaagagcccttgattaagggtggctttctttgtttaatttttttaaaaataattttaaaataatcactttaataataaacagaaaggatttgtttcttaaaataagaaaaaaatcattttttaaagtaattttttttttttagataaacacactaaaaaattgtttattttgttaaattacacacttatttcaccaaataaatttaaataaactaaccttaaaattccccaccataaaatgaattctttaacactatgttcctttttgcgcaccctttgcttgatcctcattactcaatctccttccttcgctaacaaatgctagaattcatggtcatcaatcataggctgcttggtaatggttctcacctaattggcaaaatttgcacgacgaaacaagggaatgaaaggccgctttgcgttgaatgctcttgaccctgcccacaatgatggctgatcctagagttctgcatgcaaaaaactttcttgaactttcagaggcggtcttgaagttggccttaaagaagggaatataaaggcagaagtttcttaagggatattggtgaagacaaaataagttccagccattgcagaatgtgcaaactctgactatgaatatgtggttatggcgtttaggagtgttctgagtgagttgatatacgaccctctaactgctatctttgctaacaatgatgccaaacatgctgctcatggacctgaatactgtgagacagccttgactgttgtacatattgttaaccctgcaatttctattcttaaccactaaatatcgttgcttagctttattgcattcctagccataaatcaacttgctatttaaggcaatttacttatgggtcaacttgcaacgtaaatgcatccatatttgcaattgcaggttcgaccaaagtgtagggatttctatttgttttagcttctcaccaagggagagtaattaataaaatcggatataagttttctgctatttgtttttggggtgttgactatcatctattattgtctatatatgacattatgtttattgagataggttttgtcttcgttttctttttttggaatccccaattttatgtggctaatatatacaaatgaatgaaataaaaacgattaagtgaatgaacgaaataagaatatgataaggtcccatagaaggggataaaaagggaaatatctcaggaaggttttagaaggaatgagtcacgtgtttcgttcacattagttattttttaaaggccccattagtaacctccatatccagcaccgtctcactacttctatgctcaaccaaagaaccccacaccaaccactgctccttgctcactgagacgcaccatggctcagactccaaagctaaaaacataaaccaagcaccaaaggtccatcctgtggctgtgttcttgttcttttgacactcagtgctttatcatttgtctgtccatctatcattttgccattgcattgtttggtgttatgagttttgtttctcagttagaggcttagaggatcgtctcttttcactatgttttgtaactaactaatcttttatctttaatgtttggttctggccctgccatcttcgtttattttcatgattgatggaagtttgaatatccgcgttcgttaacctagccctagtagccttagggtgcatttaaaaggatagatttaagtgtctaccttttctttttatgaaaaaaaaaaaaaaatcaacattgatcaagtagtaaataatctccgaaaggaccgaaaccagtccacacatttattttattcatccatatagttcagttcccccttctagcaaaagacttgaaagccacctagttgagcaagatacaaaataatagaaagggcgtaatatagtaataatcatcaagctgcatctcctccctcgtggaggagcatctgatcaaagtgccaaacacctgaaagtccatcaaggaaaacacgtaacatgaataccttcctttgatcaaagcaaaaacctcaggaaaaaatagaaggacacgtaacagaattagaaattcttaccatgtcctttgccaactcttctgagctgagcaacatactccgatattcttttgatagcttccacctaagaaagaaaccattcaacaatagtgttattgaacttcttagcagtcttttgccaaatgcaatgcatagcacacaatatgtacaatctctcacacatgaaaattgatagttgcgtcaagaaatttatattatacctgttcacccagatactcagtttccacaaagtcagccaactgcacgtcacctttctttgtggcaacctgtcaaacaacatacatcaagtttaaagcaaggaacttccatttttaacaatatcaatgtcaagacgattgataccaatgaaacaaagaacatgcagcaaaaccaaaactaagatcctacaaaggtggcttacactgtgcaagttaaggagcttttcgttcgttagcttctctaatgacagagcgagttccattgctgaaagagagggaaaaataattaactctgacatatagagaatccagttgagaatttcaacaggtaaagcctaaagaagcgatttttttttttcttgcactagttgacttctttatttgtattttaccattttggtaatataaagttatatatcagtactatataaatgtaacattcagtcaggatttgatttattttacataaacattatacgtaatgttaaactaggaattgaaaaaagaacttgaccgtaagtcccacaaaacaaaaatcacagctaagtatgttgagcttctatttcagaagaataagaggcgagcaataatatgagtgattgagtgagactgcataaaatccttgtttcatatgaatgaaaacagagtagtttgcttttctcagtgctccttcaattcatttccatttaataagtcactactcatttaacttttcaattcctatgatgataatttattccaaatcatttgtgattcatcacaagatactaagaatagtatcaaatcatgtcatcattcaaagattctaaaaactaggaattccaattctagaaacgatgtcaaaactgtaagatttcaaagctcgatcaagtatcttcaataatcaaaaccacaaagcactacgatgcggaaaaaaaaggttcgatccagaaaccaaatcacacagataacacacttcagatttagataacagaaaatgaaatcaaacctatttccaattaacacacgaactaaactgaaaacactaaaaagggaaattacaaggccagaaatactaaccgtgcagcgcatctcccttatctgcatgatcaaaatcagaaagcggcatcacaattgactgcaacttcacttttccaccacgtttgttctgaaaacaaataaacaaacaaataatcagaattcaacgtcaacatccctcgattccttatacgaaaaaataagtctaagtcaaacacctgatactccatcaatttctcagcatgctctctttcttcttcactcgattccttaaaaaaccttcatcaaccacacataagcattattaataactaataatgactcctaactagtataaaataaaacgatagattctaaaaataacgaaacggttacttacttggcaagtcctctcagcgcaacgttgtccctatcgaagtacgcaaacatggcatggtaaacgtacgaaacgttatactccacactgcataaaaaaataataataatcagaaggtgaaaaaagaaaatgaaataaaaccgatgagagagagagaaataggagcaacttgatttgttcgttaacggcggactcggattcgtcaacatatttttggcgagcgagagaagcttgtggaacagtgggaacgagatcgagctccttcttcacctcttcgaacggttcaaaaatcactccggttagggcgcggtggttcgtggatcctttcgccgcgcgaaccaccaatccacgagcggaaaccgaacggggaggttcggcgttcgggctgaagagggagagggacgaagcagaagcagcagcagcggttcggagaagcatggtttctggttcgggatttccacgaagcggtagatttgaaaggaaaagaaaacagaggaaaacggaacggaacggtgacagtgtgttattgtgagcgtgtggatagagatgggtctgtggctgtgtgggactaaaaggaggggttggtgatgtgggagccgttggatggggtgaaacgtggagggttgagatgtaaaggtggggctgggcgcgtggcgtgctcgtggtctagctgggtatcattgatgtgttgtccttgtcccttcaaatatctagaatcctttatctttaaaattattcttttctgggtccaattacactattttaagtggaaccttttgttaggttgccttttttccagttgtattttcccattaggggacgaaaagagcatgtacataaaaaataatgactcatgtgcgaattaatataaaagagatttgttaattataatttgtcaaatgctcaatatattgattaagaaagtaaaagataatttttttatttttttaattctttaatcaatatccaagtaagactcttatagtttaaaaatagaaatttgttaattgctatgttaataaattataattttaaatttactgaaaattttgaacatgtaatttattagcttaaattaatttctccgtgttttaatctaggtcacttcagagttaggagatctaagttagaagcactcaagtgtgtatatgtaatatgtccaatcctaggtcaaatgttgggttatattcatctttgatgtgtacaaattgagtcttgatattcttgggatcgccctttggatcgcaatttggtcattatctgagatatttgaccatgcatccagagtagatacagtgtatccaagattcgtggtcctgcaatggggccatgaagtaagaggaagtggttggctcatccatggtcggtcgacaactgagtcagtagacttggtcgatagacaaccaatagatacataactccttaatctcaagtgcgttagcatgaaaaaacgtaaaggaaaatcatgaattgattgacaattgattggtaggtacaacaagtaccaattttcttgacaattttaattaagtttatgaattattttactattaagtctttggacttgtatttatctaggtccttatttttttaaaaaaaattatgtaaattgtatttatttttaaattaaatttcaatatgaatctaattaaaaagggtaaatagttatttttatctctgaatgtgtagagcgctgaccaattcgtctcgctagttagaaattcaaatttttgtctccgaaagtgaaaaaagtgtgataaattaatccattcgttaactttcgtctgttatcgttaatgaaatagcctacgtggcacaaagagataaaaaatgttacaaaaatgattgccaacatggctgctaaatagattgaactaaaatgtcaataagtttccattgaacaaaaatgtcataagtttccattgaacaaaaatgtcataagtttccattggactaatttgtcaaatctcaaatttcgtttcatttaaggggaaaatataatttaatcttcatctccaccattttttatagttgcaaacataacattataataaatacttaagaaaatagggaaacaaacataatagtgaacataatattgattaataagcataacttgtcaattgctctgaaatttctaatgtggtagtaccttacccaaaatatgagactcaaacaaaaatgcacaatcattaagttaatccttacaaaaaatgagactaaacttgattttgtcactacctaatactgtcacaatagaaattttagagcaacagacaaattatgttcattaatcaattgtgtttgttattatgtttgttctaacttatgtgtgtttccctatttttttaagtttttattgtaatgttatgcttggaacgataaaaaaaagagaaagatgaatattacattatattttatccttaaatgaaacaaaatttaggatctgacaaactagtccaatggaaatttactgacattttggaccaatctatttagtaatcatgttggcaatcatttttgtaacattttcgtccatctatgtcacgtaggctctttaattaacgataaagaatgaaagttaacgaatgaatttgtcacattttttttactttcggagattaaaatttaaattttcatctttcatagataaatttatgaacgctttatatattcaaaaacgatattaaattaaacacaattcgaaaggtcgagatcacatcaaatttttagtagtggccaacttttcatattttctttaactttttcctaatgtctatnnnnnnnnnntataaatggattaaaaataacttctctcgtattcttattgggatacaaattttcatccctatgacgaaaataaaaataaagtaaataatattgtaattacttttatcaagagtgaacaatacaaaattatacttttaaaattttaaacaaacataaaaagactgtattctctaagttattaacttataattctaggaatgagtttttaatatcttaaataagcacagtccaaaagagtaatttggtctattttctcttatacatttgatctgactaatcctaactatgtctcctactactacgaataccttgcagtgttttctcttttcttcctttggaatgcgataaagtagctttaggaaggaaagcaagaaacatagatagataaatgtgaaataattgattaggaacgatgcttatccggatcagtgtcacgataagagctaaaaccagaaaagatcagaaagcaatcaatttcatcacattattaaattactaatgctagcgctgtcaatgagatgtgtgagataagggagaagatattcttcacttcttttttatttttatttcttttattattatttttgggaaaataaacaatattcttcgttattgtctcctttcatatcattcacttcttaaaaaatgagaagaaaagatgtcaaatcgtgagataaggttgctattcgcttatgcgatgattaaagtcactaaaactatcattttgagacctgctataatagtttttgaaattaaaaaaaatataaataaattcttaaaattaaaaacgattgttatcttaatcctttaaatttgttcttacgtaactaattagagtttaatgcttatatcattcaatcacactgcttgaaatactttaaaaaaattatttcaaaagtcaataaatttattgtatataataaattatgattaaataattatataaaactttttatattatcatacatatttttaaatttgataacttataatcattttagtctctaacgaaactagtgacaaagactgatatggttaacgaatttcgtttcaaaaacttaacttttttttgtttaatttcagaaactggtataacaacattttacaatttcaggaactgaaaacagtaatttattccatataaaaccgatacagaaaatgatgatcatgtatttttctttcttcattggtaacatatgatgatgtgtttttactttttacttcaagttttcagtaaggattgtcgataaggatctgttgggcaatgggcattacatggatgcgattgcgatctcatatattgtttagacaaactttttcaataggatggaccagacgaacccaagaaatgagatgtttggttgggcaattacttatatcactctacttttgcttttgcttggtgcaccccaaaatttataaagtcttcattttatccttttcatctcacttaatctcttttcctctccattttcctatttgacataaacggcccttatgtggatggtggcaactctgatcaagtcatcgcgccaaacattttgtccttgacatagaactcaacttgcaatgccaagtgcacgaagggatcttgaattggtgtctattatggataaattgataatatattagaataatgaattgctcaatctataatatatttttttattacagattattcaatccgtaataaaaaaatacattacagattgaacaatccgtaatatatcggaaaggtgcttgtggtgaagtcggacaaagtttaaggttgtagtgcgattttgggtttgtgtggttgtggtggtcgtaaaagggttctcgactacgtggcagtcatggatggcagcaccacagtcacacacaatgcaaatggcatagatttggggtggagtggttgcgaaagggtcgcgcacgtggcggagggcatggttctcaagcggagtggtcatcgaaggtttcgaggtgagatgcgttagtgtatatctaaggcagaggttgtgaggtgaaatgtgtttgtgtgcgccgaactagggcaaaggaggtggcgacgtgacaaaggaggaaagagatggtgagtggtggtgggcgatgtgactgatggaggtggtgggagagaggaagaagaacagaagaagggtaaatccaaaatattagaaaattatgagatgataataaataaaaagggaataattatttggttagaaattaattttaacactaattttacctagaaaaatagtaatgaccatgttgatttaatttgattttgttatgtatttaaatatatattaattatgcaaaaagaaattttaattttgattggaaaaaaaaaatctttagaggaaaagtttattcctataaatttagtgtaatatttcctatttgtttttatatatttgaattgaaatataataataaaaactataatttcaccacttttaactttcaaattaaattattgttttcatattttttaaattaaattaaatttgtataccaattaacttagacatgtctattgaaaagaaaaaaaaaacttaaggatgatgttattaaatgttgtatgattatttaatttactatttgattttataaaaccaatttcttaaaaaaaattaatcgaatttcaggaattaaagttaatgtaaattaatatattagtagataaatatatatttaatttattgaattacttaatctataattattataatgaaaattattacatttgatgtatatatttactattttcaatttactttcaactagttttctcattactatcaatctggaaaaaaagaaaaaaaattaatgactctcaaaatgtgaacaacatactcaacaaatataatgcatatatatttaatttattcaattacttaatctataatcgttataatgaaaattattccatatttatatatttattattttcaatctaccttcaactattttttttttcattactacctatctggaaaaaaagcaaaaaaaataatgactctcaagatgtgaacaacatactcaactgtctactacacgaaccacaattgttttgtaaacaatgcgatacgaatgcttcatttgtccctagttttaataaaataaataaatgacgtgatttatttcattaatatgaattgaggagctaaaaccccattgttgggagtacaccaattcaacgctttgatgtaaagtttttaactatctatttaatgttatttgcacattattgttgtttttctgagctttattcttgctagtggtctgatcatccatttgtatgctttgttttaggttttaatgcatggaaaatggttattatcttaagaactaaaaaatgtttctaaacaatatcatgtctagggataaagtgattgagtttagtctaggttatcgtctctaatcgtaacgcaaatcgtttaatgtaactcttgagggattaagggtgaacttaagtgatttaggtctagcacttggggaatcaaggttagattatattagtagatgaaggtgatcatatttaatgttgaatggagaaaaaccttttatatcgcatcaaagttagttccggttaacgaacttccaatacctttcatatcgtattccaaccatccgcatcattccgagtgtttgtgtctcttttcttgtagttatgacgccttttaatttacattaagtataatttaatcttatgccaatcattttaccaattaaattcattcattaattaattaacaacgaacgtacattagtcttaagtacaagcaaagtctatgtagaaatcgacattttgtcttaccagatctttattacttgaacaattcgatgcagttgtcgaaccgttatcaatacgtgtgtaggtatttataatacaactgatggttgtcttgaaaaaaaaaacttataggcaaagactaattataattaatgtcttaagtatattgattaaaaaatttaaagtataaatatttttattgtgagatagaaattgtattgtttatgatttttttacacttttatatgatttacataatattttttttcgttttagaatatatgatgttttagagaagaaattgtgtttcaaaatatatgtcattttttaaaatcaatatgatattaagtactttttttaagaatatctttaataaatacttagtggagtagtgcataaaaaattattaattaaagagataaagaatatattagaaaattatctaatgttttttttcaaattcaacaaattaatttcatttcttaatatttaggtaaaaacctcaaacatagtatattttggaatggagagaaggtatatatatatttcttttattttcttaatcaattctctaagaacattgattaataagacttaaatttgtatataattgatagtttaacttataaccaaagacactccctttatgtgttaattaatattctcctttagaattattcttgaaaattaaaaaaacatgcatctcgaaaatgaatcttcatggaaacgatgctcatttaatgttgcgttgaaggtctcatgtttttccttctaacgtggtgagatgtctgtttcttcagccatattttattgtcttcaaaatttgtgatttcagagaaaccaaacgacaggtttctcagcttcagcttccatggtctcaccttccgaggggttgaagttctaaatttagaccctatctgttactagttctaaattattaactactcgatatgctttgaatggaggcgttgatcaaaatgagtcccgtcaaattgaatcttatttcaataagttttttttttaataaaaaaatgtttttttacaaagattatttctatttttatatgactttaataatttttttcatttataataaagtgtataaaatatttaggaataaaataaagataaggacataattgtaaagatagtaattaatattaacttgaatttctaagtgaacaaataaatataaatgggtttttgctaggtgccaacttacgatactaattaaaaaatcaataatagattttttttaattaaaaatcacattcagatatattaaagatctaaatctattaaaaaatagttttattaacaattcatccatcagtttgatccgtaggcaagtaaatccagacgctcattaccttattaggacgttttgattttatgttattccaaaggtttgttgatactcctctattaattatttgtttataaatgatatggacttttgcagtaaaaaaaatagatttgtttctttacgttagagaaaaacacaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcatatttttttgattataaatatgctacttgggttgtattaatttgtctttgttaaggctttcactcaaagcaattgaatgaaataacaaagatgaatgaatatataactcaagtaatttagaaagtatcaattttctataatattaactaattctgtatccacttacgaaacaaatttagaatatatgttgaaaaaaacaattatactagtaattttatttttgctgatagtaattaagtgttaattaattaatattcgatcgtgatgattttttaattatttttttggtaaatagtagtacatcctaacattagtactttaatcagcatgtaaaatttaatatcatttcattcacttgttccaatcaattcaaaggtagtgttacacatttattttgaaaacaaagccttgcacattttgaaaacaaagacgtataggagaccgacatgccatgaaagaagagctgttttatatgaaaaggaagctttgaatcatgtgaggcaattaatgccaggaaagcttagggtttctaccacactagccacaactcgtacgagtttcaatagtaatctccatcgaaatgagcttcatttataataatccctacaacttaattgaatgtcaggaatctcattaatagcttggtggtgggttttgtgttttctttgcttttcaacaaacattattactatactatatgccatggcattcacatttctgccatttgagttaggtcataaagtattaatcatgtttggtttcttagaatttattaatattcaaacaaactgacctatagttatataatacaatatgtcacagatacacagcaagcaatgagctgggcaggtatcttcgtgatgaaattacatgtattattagtatataccaatctgtctatcttatgactcttgtagaaaagatatttaactaaagtaaatactagtactaaataaattcaatagcaaccatgagcaagagttattcaccgattgatacacataaaaatagctaggaaggttatatgatcgagaacgaaattgtatgtatgatgcttaagtaaagaataaaataatgaaaatggctacagtttgcattctatcatttgcaaaggagaaaaaaaaaatctctttttgggatgaaaaaaatatgccatgcatgtcatcagtggttcaaaaaaatagaggattatgatgaagcttaccatgagaccgcagatactgcttagctagcttctccattcaatggagattaattaactatatccgcgcgacacatcaatttgtgaccgatagatatttaatttctaatagtattagtttgtaacgataacggctcacgagacgaatctcttccattcagcatgtgatcaggaaaaaatctgttatatcatatggttgttgatatatcttcctttgtttgagttttcttgatacggaggatctaatatcagcttattcaaagttgcccatttgaccagagaagatgaggaaacgttctattcattgatcggcctaaacatatatatatcttcactatattgtaagaaacaaccatacgatgatggtgaaatgcatcaatggaaaacaaaatcaacaccatacgatgatatatgcctttatatagtagatatatacatgcatgtacactagttttgaggaaagaaacaacctttattttttaaaaaaagatattagaaaaaaaatctaaatctaaccaaataaaaacattgtcttttagttcaagaagagccagctctcgttaatttagtacaagaagttttacactattcacccataagaaagtataagtagaatacgactttaacataattattataaaaattaataaaattatcctacacaatcatttataatttaacaatagtataatatttttacagatttttcactaagcatatatgtatatgtgcagtatagataaataattggttttgataagatttgggtgtgaaatttataaagtcaaccctctatataaatcggtcaccttaatttactctccatatatactcgtgtctacctcttctatgtaacttaaataaagatgtacatttctttataaccaaaagatgatatgctaatcagctagctgatcatgagctaatacaatgaattcagtcaaactataatcttaggagagattgatatataaggaaatgttgatcagtatgagacggtttttctgtcaaattttattttacaattttttaaatactatttattttaaaaaaagatattgatcagtgttgctatttgtgcatttggtgtcctgccagggaattgataacgtacgtttgtgcattcacgtgaatgcttttttatatgtcattgtgatagtcatagtcatagagtctaacaaatattcatgtgttgaagcttcacatatcttagtaatgcccgggtacttgcaacaggtcctgtgctcttgactcagcagaactaaacaaggtacgtcacacccttattcaaatacgtgggagctatattgccaacttggctgtcacaatccacaacttttatttggcagtttctcagtcataattgttgttgttatttcctctatcacccttcgaacccaaatcagcttaccatatagtgacaattctcaagtcacttgctctctcagctatggcctatataataacaatatggagacttgaacctattagaccccgccaatttcagcaataagtcaatacgtgatacagcttttctaccgtgaagcagaaaattttcttaatttgactctcaatgaagcaaaacagaagcataaaagtttgtgtaataatttcctgatttattttatcatgaatatattattttctttatagtgccaatagttatttattacttactaaatatatagttttctattgtgcctctctatttaaatagaatatttttgtattggcgtgtgctttgttgcgttttgttttacatgattatatttttgctgaagtataaaatgtttaaaacatttacttttatcagcctatggaacctttacgctcactagtccgaatttcaagtgactgatatggatccaccaagttacaatgaaccacaaggcctagagatcctaattcctagacagagctaagaccagggtgatggtattatatgccaaagtaattttttattttaatttcaactctagacgtgacaattaaataaagcaatgcatacaaaaaaaagaggaagaaaaagagatataaataacttaatctcttaatttatctataaattaataaatattttaatagttgaatgtaattgttactttagggtccttttatttgcagagaaaagagaaagaaaaaacagttaaataaacattaaaatgtaaaataatgtataattcacgtatttacactccactttaatttaaaaattttaactcaatttattttttattactttaatttaaaatttttaactatttatttttattccatttggttctattctatggaagggacccttaatgacaatactgtagcgtaattagttagcaggcggctaatctcagcggctgtattccattataaatacatcaaatctttcaatcttggtcttattatgtgcaactctttgatttgtgttctattaacttcctctgttttatgcttactccttttctccttttagtcccaaacacaaccgtttttcttttttcagttttcctttgtttccaaaaaagaaaaaaaatgggtggaaattccccttgtgcctcatgcaaattgctgagacgccggtgcacaaaagactgcaccttcgctccttattttccttctgatgacccccagaagtttgccatagttcacaaggtttttggtgctagcaatgttagcaaaatgttgcaggtactttttccttactgtttctatttgccttcttttgatgataataaaaaaaaaaaaaatacccttttgtggttagttagttatttgatcaatttcagaagcaaagaaattaggaggtgggagattcaggtaagtctttcagatagtgtttgttaatgagcctgttttaagaacttttagaaaaaaaaatttcacattagctaaaattagcttatgctgttatagacaagttaaaaataattttttagaaaaactacaccagagaaattctacaaattagattatgtataagcttcttagggcctttgttcttttggagttgtaagtagtgtttatttttagtggatcgggggctctaaatggttgtttcttatgcaatgattcattcaggaacttccagttcaccagagagcagatgcagtgagtagtttagtgtatgaggcaaatgcaagagtgagggatcctgtgtatggttgtgttggagccatatcctacttgcaaaatcaagtttctgagctccaaatgcagcttgcagttgctcaagcagagatactctgcatccagatggaacatgagccagtgatgccagcctcacaaattgatctagaccacaagtcttactttctccaaaatgacctctctcagtttcttgcttttgactcttctagcaatgtaatgcagcaattttgcccatgacatggtttcttgaatgaaaattgctcacatgctttgggtttggtctattcattattttgtcttttctcaatctctgtgagacattttatatcatacatctataaactttttctatctaggattctaggtagtgaggagatagggaagggatttctaaggttgaccctagcacttgattaagtaaaacacttaattaaggtacttgatgttaatgcagccggtgaggacaaatatttatggtcgtaactaatgtttatacaataatatttaaattttacaatttacaagaaaatatcaataataattgattatgtattatatgaggaagattagtgaagacatgatccagaactatttaataatttcttagtgtggacaagtttagtaatggttttagaaagtgacaaacattctcataactatataaaaaggctatctcaccatcaggaaagaaaatttacatgtctaatgaacatcaaaacattttgtttttctcaactaaaactgttctcgtttctttagctagaattttttatgttgtcatgacaattaagttagaactttaaaccttatataagttattcaaacatataagctagatattttgtccaatatttgaatcatagtattcaaacccacacctaattgagttgtgtatcaattgattaatgggagtgtccttcacaattcttaaacacaattttaacatctcannnnnnnnnnattattataaaaaataaaaataaaaaatggatcaataagtaacggattgtaattcatctttttgtgcttaaatattgaacggaaacacgtggatattactagcttccttaaagtaaaatgttagttgaggtacttttgattttaaataacaaagtgcctagctgatgtcattcgggcacttatcaattaagtttttttttataaggatgttagatgacatccgttaacatgaaagaaactaagtgcatctttggaatgacatcatgtgatcatgtttaacacgataattacttaaaattcatttaaatgacatagaagctaaaataaaatgcatctaaaatatgtgaatatgtgagacgtgacatcaaagcaaacaagtcataaattaattgatgatttacaaatttaggaattattttgacatttttttaacttcatggatcaatttgatcgattattagaatttgtaagattaaattgattgataatttatttttttaacgattaatctgtcattttgttaattaatttcataaaccttaattgataatttcaaaagagtaaattagttattcactcatgaattgctacttctttttctctctttaataattttattttatttttctctcaagatataacattccctaatatattaactaaaaactcgttataaattacgtgtataaagatgcgaacggcatgaatagagaaaatgtacgacatacaatgcctttacattgttaattagaagttagatatcatttagctctcacctttctcttaactttgccgtaccatttaggtaaacttgtgaccacaatgaacaccagaaatcacagggacagtggaagctgacgcgaactttgtattccaaaagagaggaaaagagaaaatcgaactacccctaaacgtctaaattaaccattacttgattaaaaagcgcatgcttggttcaatgattgagctagtgattaaaacaaatgataacacgtttttaaacaccactagttttaaattaaatctgttggttttggacccttaagcatcttaatgaagattcaattatttgtgatgtatgagaaacaaactcatgcatgcatggatgaaagagcttagtttccacactaaaaagttaatttatttttaaaaaaaattatacttttatttagttatttgttttaaaaatatatatttagaataatttttaattaattaacaatataaaaaatttacacttacagtgtataatttttttattaaaaaattacatgaagcctcacattggaatgagagaaattgcaactgtcgttcttgtttctttgaattttaaaatgaaaattttattattcatggaattagatggacaaaattgtagggagttaaaagatgctgaattatatttgacagcagttgaatagaacaacatcattagtaatttagaatacagtaaatgacaaatattcgtcaatatgaaattctgcctctttgtggagacaaagaaagtgataatgggaaccacatttatattttgagggctcgaggacaatacttccaaaataagttttctttggaattcagatgccactaacccaccctccccagttcccttctctttgactttgttttttattctttcacttaggtcaaagtaagattttgtggcacttttcttcaacaccaaacaaattaacattatgctaaaaaaggctacactatattgaacttgaagctatccatatactccatatcaattttttttttgcgcgccgccataatgtatacaaacaaaaccgttttggtgcaaattcaaatgtttaaaattgtgcagcttggagcgttgaacctcatagttactagtattttctagtttttggaaaacaattgttaatttagttccctaattctagacgcgtggcatgttaggttacacagagttgaaagttgtaggataatagtgtttcgagtcttgatagcgcttggtatgccatgttatgttacacagttgaaaattgtaagataatagtgtttttgagtgttgctaacacgtgcttagttactgatgaatttttgtttaataacgtgcatgtaattgcctagtgttttataactaataaatgcacacactttcaatttaaatctacaataaataaagaaagacataaacaaagagataaatagataaacacttgtcttcacagtttcgttggacttgaatgatctaaagagacttacgtacgttgttatttgtatagaaattatgaacttggaaagcagcaaattatgcttagttttacttgctgcttaggaatcacatccaattcgaaatccaaatataaatataagataggtacttcataaatgacaatttatgatcctttatctccaattgataacgtggagactttgctaaattctgatttaatttgttccatcataaccgcagacctgtataatgaatttgagactagaagtgctagcaggaactttgagctcagaaacatagaaacagtttacatgtgctactccaagatactcctgcacaggttccaatgttgtgcttggattaccatgtgctagctatggtggtttctccacatacacattgcagtgtgaaaatgcaagattctgtccatttttcagtttccaagaaattttaacgctaaggatccttgaatcttgaggaccagatttcccattgatgcattcaccatcaactagcaacgaagtagaaactggaaaatctggcttatagttagaagtcttgacagtgatgtgaccaagaacagcaaaataatcagttgaggaacgcacagcatgatcaggaccaaatggtctggatttcatggaaggagcatttggcctatagcacaaagcatggattccagtgagaatgtaaccatttcaattgtaccttcatgtataacccatccaggggcatttcccttgtgctcacttgttaggactactttgctaaattcacttgacagatgatccattccatgggaagtgagtagtacaggcgttgttttgttgatggtagaagtgaactcaatgaagaattgctatcagatttcacctgcatttgtcacagacttcaggtgtcaaatagactaagaaaagtgggtactgatagaaatctcaaattgtatataatgattttggtgaactagtcagtatgtgcactataccattggttaaggaaagatacatatctcacttccgttccctcaaataagtatctagatttagctccctaggaagataagctatttttttagtaaatttttattttcactgctgtatcggcgctttctagtagtgtcaggttagatgagtctgatggccagagatgtaaaggcataaaatcattggtgcatttgcctttgcgagagttgggtcatgacaaagagtctctatgaccagaaggtctaaacttcaacctttgccattataatttctaataaaaatttggatttcaatgcaaagcaagtaagcttgtgcatttgcctagttcaagcccaaagggtcttacacgaagtggtgtgttgaggataagttattaggtaatcttggatcacatggtctccattaatttccctatgacatgttatcaagtgttattaatttttccttgtaaattgaaaaacttgaatacatgtcatataaaaattagttgggaccatgaacagtggtggtcctggaccactttataatttctcatgcttgaaatatacaagtaaattcatgtgcctttagctaacaatttaagattttgaaagagatgagcatgtaccctccctatcatgcttcaaacctgaggatagagatatgtacaatttttccagcaattttaatagaggtgatagctttaagaataaatgaagtgaataggcaacttggctaaaatgaactctccttgaaagattcttctcttttaagtaccctctccaagagatccttcgaatgtaaatttccccctccactatatgatgcttccttcaagctacattttataagcaagacaacatatacttgagaacttatctgaactagttctgaaatgtagtaatttaataccttgatttaaaatagaacagaaaagaaaggaggcatacaaaatcatggaagttgtaatactacaaaaactaaaagtacataataatatgagaagtgtttgcacactatcaggtcagccatcaaaccttataaataagttccagaagcacataatcttagcaatatgtgatacttaatcatatttccagtctcttggtaccaaaataggccctcaaaattcaatatggaaagaaggagcctataatctacactgaattttctgtggtgaatttttgtatcggagttaattttgccagctatacttcaaataatactatgaaagatgcaatatacacactctgttggaatttccagttaaagaaaattataaagcattggatgctttatcactttacaataagttgaatagaatttgcagtagaatcggcaaactgacggggtgcacgacgcggttgcctgaaaggtcctttgggagtgcgagacctcagatatcaacaagatcctccctgacaacgatgttttcttcaaaggaaagaggagaagattgaagaggaaaaggaagggggtggggagtgcaagaaattgcataggggttatcttggtcctttccttagtattttaaaatctaagtagtgggaataacaagaatgatagtgggaatagttgttcgcccatgttatggttttagtagtactgtaataatacttttaacttgttatgctttcagattggttattcttaaagccaatatttataatcattttataatgtaattctagattggtaatttcataacccaaaaaaaaaaaaggtgcgagaaacaccagcctgagagaaactatgaaagcgtcatcaatcaaatagtttgtcatctccactcaacacgacaactaattttgtgtatattttttaaaattttggtcaatgaacaaaattattttttatcaataagataataattttagagtttaaatatattttagtttctgttaatataacgattaattcctgtaagaaattttctctcttaaaaagagaaattattaaatagtcttgaacaaccttctatccatgatcataattaatttctatgtaatacgtattttaagctttttaatttgaaaaaaaaaaaacacttaaatacatgtatgtaaagattaataggaacaatataatagttcaaaattacttaataatttctccattaaaagtttccgacatttttaggatcacatcttttagtcactaccttatcctctttttgttatgtgctgatgaaaggccaagttaccgatgccacgtcaatcatgtgaggccacatgtacacaacttattgagtttcttcttcatatctgaaaacctttatccacctaataatctcttgaacgtgtttatataactagtgctcaatgattaaaaaaaaaattaaaattacttataagaagctgtatcagagacatacacagaactcaggtcacatgacttttactgttgctcttgccataaacttgataatttgattttgtagccttactaggatgtggtcaatcttataattcccattatgtggcatttaattaggcactatataatactaagtgttaaccttggttatgcaatatctcatattggattttctaattttcacgttctaaatagtttggctagtgtatactcaatatgttggggtcaattattggaatccataccatgttacaactacctaccttagaaaattacaagcattggttttatgtgtcagggaatgcagatacactcatatggcggtggaattggaaatgactcataattgatgcccatcatgccatattgttacaagtgggtagttaattacagagctaacacatatacttgatcaatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaattgtcctatccttcaagcagaaattctctttgtaggttttattgtctgcttatcatttgtggacttatccaaaaattagctagctgtcacttgctcatatgtattatgtggaggtgctttttaatggtgttaactaaacagttcctcatcttttacttattattgatgcactggacttgaaaatttgattgactcttatccggacgtagcttgcctataagtaaaaccagtgtggtctctcataaatcataatattactctcttatattatttacctgctaatgcatttattttgaaactagaataagtagttctaatgcctgtataggattaaacaagttatagatagttaaggatttcatgatgtgacaagaaataaagtgaaatttagcggggtgtttcaagtaatttttttttgaaaaggccaaaattttattaatgcatagaaattaattagaaacaaaacccatgtacaaggtattaatgcctaagttttggaacagagtaatattgatgccccttctccttgtcagcacattcttccttataaagaaagcaattattgtaacaaccagtagaagagttggggccgtagaagaagcaacaagaattttagctagactccagtgtcctaacatacactagcatattttaccagaagggtaatctttcaaagtattttatcttttcacaaaaatacatgcactagcattgatcaacaaaaatattttgtatgtttaggtgatccatcgttctaacccttttatattaatgtccaacaaattaacctacaactgcataatatatacctacaacgtctgaaatttctatgttttggtgagaatctaagtaacgacgcaagttagttccaaatggtagctaaatgtgacctaatatatacctaatcacactccacctaatgtccaaaacaaaattaattcttaaagataaaaaaggccatactggtacatcttttgtttatttgggtacaatcatttatatagaaaagggaagtcaagtgattatgattagcaatcttccatgcgtccttaactttgaagccaagcaatgtttataatctccaaacgtagtgttcctctcgtagtatcgcaccatatggatcccactcgacccaccatatctcttcatttcacccttctagctcgcggttgtaattacaacctctttttttttttttttttttttttcaagagtgatgttacatgcttgatctggttgaatatttaacatatatccaatttctcttacaactcactttcactttatttttcttcttatttttctctttatttctcatttcattttgtcacatctatcgtttccttttgtcatacaagccgaaattgggatacacgaataccattactctttaagatgtgtatcacctaatattgttgtaggaaatgtttcagaagaaattgggacaatccaaaaatagcaactcaaaggatatttacttgacataaaaaaatgacatattataagtaatatctaattatctttatttttatttatttcatctacatacatcacaaaatatactctaaaaaaagtaactttatttgtcccatcccatttaacattcaccaaacatttttctattaatggctagaaagaaaatgaacaagttgccgtaatcacacattatagtactgtcatgtggtgtggtatagctttcgcttctcattcactgatctttctttcttttttaataaaacattcaccggtctttctatacctactattgagagagtattaaactataatttattgtcttataatgatgataattatacaccttctatgtacatcttataggaagaaaaaagaaaaaagaaaaaaaattataactttcgatgatttttgtcataaaaatgtgtaacttaaaaaggtcaaatcctttctcctcaaaaaataaatgtcaaatccttttagtagtcattttcttttgacaattttattgtattgagttttattttttcagttaattatataggaacactatgacacaaaaataaaagtgtaatttttatatatttttaatttaaaaaattatcaactaattagaaatcatatataacttttaaagtaattaaacaaaagacaacaatcttaattttaagataatcttagatgacactaacaaatatttacattgtcaatgtattttgttaattaaatttcaaacgtgatactcatattagggttttttagttcatttttatttttttctctttcaattatttatactaatatgattcttttccctatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatactttaataatccgttttggataaatccaactttaatcaaaaacaacactaaaagaatactttaagtgactttagtgttatcttttaattagaatttgagtttaattaatcttgatcattcatgcaagtatttatcacattacccaacttgtcatgcatatattctctctcatgagtaaaaattaatgtataaatattaatcatttttttgaaagggtacaaatacttggtgttcaattatgtggttatttctcttttctgcaaaaatgctgatatatatttattagtcattaatcatgattttccatccttgttaatttggtggttatctataagacagaaatggaccccttaatccgttttccttaactcgcacatttcctcctttttctcttatcttaacttttctgtttagctgttctttcagtcaaagaaaaaaattgttggctatattaattaaagaaaataaaacatacatgatagatatatagtggcaggggagaaataatagagaatcggtagttggttgggtttggtgaatggtttcatttcatgcaaatgaagccaccattctcaccctcttcttcccttctcagaggcaaagcacgcctctctccctacctctttacccttatagctttcattctctttgtcgctatcctctatggcgaggacttcatgtgcatctttggtcaacacttccaaaactactctaattaccctcacaaactctccaccaccaccggtgggttcatagttcactcacttttttaggctttcttgtggtaattctatctgacaaaaatatcagccacactcttatataataaatatcagttacaaaatagttaaagtacatatattgtttaactgagtaaattattatttaacaacaacaaaatatatgacttaaaacatttgatgaaacattaggaatgaaaatggccgaattacgttttctaattaaagcttctgtttaatttgtggtatcgtgtgatgtgacgtcttcttttgttgaattttggaacaacagagatggtgaagaggcagaagctgccgtttgcggtggggaaggcggaggaagggtgtgacgtgttcagcggaagctgggttcgggacgagttgactcggccgttgtacgaggaatcggagtgtccgtacattcaaccacaattgacttgtcaagaacatggacgacccgacaaggattaccagaattggaggtggcaaccacacggttgcgatcttcccaagtaagccatgtttggtttaaactttggtaaaattatttttgatagagtttatattatttgaaaacttgtaacagttttgtatgtatagtattattgtgagtccttaattcgtgtatgttttaattcacttgagcgatttgaaatttgaatgtagttttgtagttaattttgatagagtttatattatttgaaaacttgtaacagtttcgtatatatagtttagtattattctgtgttctgaattcgtgtatgctttactttacttcacttgagcgaattgaaagttgaaagtagttttgtagttaattttgatagagtttatattatttcaaaagttctctctttcctttatttaccttttatttacgccggggggaacgtattttagggtggtcgagcctcctactcatggaatacagatggtgttagaatcaatggtgatactgatggatcgggggctcgtgtcagaaagtttggaacaattaaatgaggcaaacttgaaaatatctgaaattttttgtaaccagatgtaataataaacattattaataagctttttcatttactcttttaaatattgattacaatttattaaaaattataaaattgtgtaagttttattttttatttaataaattttacttattgttttatagttttaataaatttttaagtaaaagtaaaaaacgtgtaaagatgagtttgttaaaaaaatgttttacaagacatctctctacatgaaatattcggtaacgctcatttaaataaggtaaagattaaaattatacctagttatttaaagaataattccaaaaattatcttgcaacacataatatcaattcaccatcatactttctttgtatggtaaatttgaatgtgttttatacttttaaaatattaaatgaatttattttttatttaatattttctttatagagtaatagaaaactttgtagagtcaatgttaaacaacatttttttttcacgacaaatataatggtttaattcaaactttattgtagattcaatgctagcttggtgcttgaaacacttcgtggaaaaaggatgatgtttgttggtgactctcttaaccgcggtcaatatgtctcttttgtgtgccttcttcataaactcattcctgaagatggcaaatcaatggaaacctttgattcactcacagtattcactataaaggtaaaataactttttggttgattcactttgtgatgtttctagttttagctttgtaatttagtctttttttcttctttctattgattttaatgtgttcaattaggaatacaatgccacaattgagttctactgggcaccttttcttcttgaatcaaattcagacaatgctgtcattcataggatatctgataggattgtcagaaaaggttcaatcaataagcatggcaggaattggaaaggtgttgacattttggtattcaacacttatctttggtggatgactggcttgaagatgaaaatcttgtatgttttctattgtattcaaaataacaattgcttagccatctttcatttctttttctaagtagtttgatataatatttgatttatttatttctcaaatctttagacttggatctttcgatgatgaagtaaaagagattgtcgagctctcaacagaggatgcttaccgcatggctatgaaaagtatgcttagatgggttaggttgaatatggatccaaaaaaaactagagtgtttttcacaagcatgtcaccttcacatggaaagtgagtatagctctctctctttcataaaaaaacatgcacacatatactgatatacacatcagtatcaccatcatatttttgtaagctaaaaattgtggtaatgtacactgtagttgtcatatttcaatgttctttaccaacatcctatgtgacaataacctaatgtttcttcataaatatgtgacaggagcatagattggggaggtgaaccaggagggaactgttacaatgagaccactctaattgatgatccaacatattggggttctgattgtaggaagagtataatggaagtaattggagaagtgtttagcaaatccaaagtgcccattacatttttgaacatcacacaactatccaattatcgtagagatgcacacacttcaatctacaagaagcaatggagtcgattgactccagagcaattagctaaccctgttagttatgctgattgtgtgcattggtgcttacctggccttcaagatacttggaatgagcttttgtatgccaagttattttatacgtgaaagttgaaactatttcaaatataatagatcttcgtgcgttctcatggatcattctacatttggcacttcaagttgtaaatgggaaagcatgacttgacaacttgtggcgattattctttatttgtttggaagtgatgtttggggatggtcacaagcaaaaatcaaacaaatgaaaatggatgtgtgcacaataatagttgccaatcaaaaaagagaagaaatatatgagaaaaattgaattgatttcttctctctttcctatggaagaaatgtaaaaaaaaaaatgttagtttatcaatccctaatatgtcatccatataagttttggtacattatgttgtttttagactcgcatgaatgaaaaacttacctaaaaaaaaataattagtttggttattttgagtttaaaattttggaggcatatatattttagtcatttagaggaaaaatatataattttcttaaataatgtgagattttatttttcttagctttagaaggtgatggcttcttccaattcccttataagatccaccattttcgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaaaaaaaaaacataaatagtattagtgttttgtattttattttactttttatacttctgaaattaaaaaattaaaaagaaaaaattcaatgcaagagcaaaatatcttaaatttgcgaatatttttatgaaattatggtatactactagtttaaaaaatttcatgaatttctaattattctttgtccacaactttcgtgaacttcgtctttcatattgttgttgtgccaaagattgggcctgatattggctttcaaaatattcacttttaagtaggccggttttgttaggtgcacttttttatttttcttgcaatagagtattggttttattcaaacaagggatttattaaatacactatataaatttttaatacactatatgtaaatagtgtacgaaccggattgtccaatccgtaagtaatttttttttaagttaaaatatattttttcaaataatttaaaataatggcgcatgcaggtctcaaacctatgaccttcatgtttttaacgcgacgctccaaccaactgagctaataagtcaattatgttaaaaaataattaatgttgatacatataatactaaattttttaatgtatatttaatacacatatctaaatctttaattgtttagtttatataatttctttatcttttcttatttcagattcttactttattaattagagatattatgttcattttatcaattaggataattgttagttatgatcctatcaaataggattctcttttatttaaattttatcaattaatgagttatatataattaatttaatttaaattttattttgaatattgaattatttctcatcctattactttcataacaaatttttttaatgtatatttaatacacatataagtttagataataaattatgttaagaatattaaagtaatagcattagaaataattcaacaatcaaaattaaattaaaattaaattaattatatataactcattaattgataaaattaaaataaaagagaatcctatttgataggatcataactaacaataaccctaattgataaaatgaacataatatccctaattaataaaataagaatctgaaataagaaaagataaagaaattagataaactaaacaattaaagatttagatatgtgtattaaatatacattaaaaaatttagtattatatgtatcaacattaattattttttaacatagcgttaaaaacataaaggttacaggttcgagacctgcatgcgccattattttaaaattatttgaaaaaatatattttaacttaaaaaaaaacctacttacagattggacaatccgtattgcccatatggattggacaatccgtataacttaaaaaaaaaaacttacggattgccgaatccgtaagattcttatggattcgacaatccaaaatccgtatgaaggttacggaatccataactttcaaatcacggaaggcattttcgtccgtgcactgttcacatatagtgtattagaaatttatatagtgtatttagtaaatcccttcaaacaatactacgtggatttaagcacaataacttaagcctaaatttcagccttttcttcctgctgtcttgttcattgttattccctcgagttgaagaaaacccagtcacatgtgcacgtagtagtggagagattttgctattttgttttaggcccatgaaattcacactcctattttttatcttctcgcccctacattatttttgtgaaatttctattttgttgcgtattactgatatgatagaaactaatttctatttcttgaaatggtatcacccatggaggataaaagcaatcttgtaatgaaagcaaaaggaagaagaatcttggaaaataatgtttctgtttatttattaacttctggtatatcgctgaagctataaaagccagatatatatatacaacataaacagagttaaaataactaaccaactaactctcaattaactaactagagttccactactagttacagatataaagatcaaattaacaagctaagatcccccctaaagctcggaatgaatgttggacattcctagcttggaatataagaactgaaaagcagcaggcataagggctttggtgtatatatctgcaagctgattggcagaagatattggaagcaatttgacaagccctgtaaggatcttctctcggatgatatgacaatcaatttctatgtgcttagtcctttcatgaaacacaggatttgtagcaatgtgtaaagctgatttgttatcacagtacagaacagcatgttgatggaaagaaactttaaattcttctagcaaaaaggtgagccactgcacttcacaagtgacactagccaaagctctgtatttagcttctgatgaacttcttgaaacagtagcttgtttcttagatttccacgaaattaatgaagaaccaaggtaaacagcaaatcctgtaatagatcttctagtgttaatgcatccagcccaatctgaatcactgaatccttttagttggagatggctgtctgtgggaaagaaaatgcctgcacctggagaacctttaatatatcttaaaattcgagaagcagcttgttgatgagctgatgttggttgagctacaaattgacttaaattttgaacagcaaaagtagtatcaggccttgtattcgttaagtaaattaatcttcctatcaatcttctataaagaggaagcaaattcatctgatagaatagaaccagaattttgatgcaatctgacagtataatctgagggggtggatacaggtttagatcctagcatgccagcatcaacaagaatatctaatgcatactttctctggcaaagattaatcccagcagaggtacgagccacttcaaagcctagaaagaatcttaaatcacccaaatccttaattttaaaagcattatccaatagctgtgttatattctgaatctcagtcaggttatttccagacaagactatatcatccacataaaccaacaaagcagtgatagaattgtcataatgtttaagaaacaaagaataatcagaagtacattgtttgtatccatgagatattaaaaacaaagataacctggttgaccattgtctactggcctgtttcaaaccatataaggacttttgtagtttacacactaaacctggcttttctggtttcattccttgaggaatttccatgaaaatttcttcatttaaatctccatgtaagaaagcattatttatgtccagctgttttaggtgccatttgttaatagcagctagagctagtagcagcctgacagtagtcagtttagccactggagaaaaagtgtcaagatagtcctgaccctccacttgagtgtatcccttggcaactaatctagccttatacctttctatagaaccatctgatttatatttgattttatagacccacttacaacctatggcagatttgtggggaggaagattagtaacagtccaagtatgattatcttctaatgcttgaatctcagcattcatggcttgaatccaattaggatctttagatgcttcaatgtatgatttaggttcagtttgttgagtgacagctaaaatggtacaatggtaagatggagatagtctactataagaaagtacagaacttaaaggataacgacttcctgtagactgactggaaacagttgatggtaaatagctaacatggaaatctttatacttgcctggtctttgaatctgtctttctgatcttctaagagcctgtggtacttctatgggtgtagaaacagaattgtatggaacagatggtgatatggaagaagtagagacaagcaattcattgtcatcatcaaaataagaagtaggaacaggcaaagcagtaataagatcaagagattcctgagtaatgaaaggaaaacaatcttcataaaagataacattcctggatatactaatgacccttgttctgagatcaaaggtgacataaccctttgtgtgtgacttgaaacctaagaaaattgaagtagcagctctaggatcaagtttcttcctatttgcagatagtgtactaggaaaacaaagacgaccaaagactcttaaagtggtaatatcatagggatgtccatagagtttttcataaggggatttgttgtcaaggaagggtgtaggcatacaatttataagaatagcagaataaatgagggcataggaccagaaaataggaggcaacttagatttaaagatctagtgatattaagtaaatgttgatgttttcgttcaacaatcccattttgttgtggagtttctacacaagaagtttgatgtatgatactagattcatcatagaattgtttcatgatgaattctgaaccattgtcagaacgaatagctttcactttagtatcaaattgcctttcaacaaatgcaacaaatgattttaaatgagattgagtttctgctttagatttcataagaaatatccagacaaacctagagtgatcatccactattgtaaggaaatatttatgaccatttaaagaagtaacatggcatggaccccaaatatcaacatgtataacagaaaaaagggaaaaagaatgtgaattactgtcaggaaaaggaatttttctttgttttgcatgatggcaagtaggacatacaaattgtttattaattgaaagtaaaggatgtgattgctttaacaattgcaatttttcaaatgaagggtgtcctaatctaaaatgccaaaggtcaatgggtgttttattataagagaaagtgggattattagaaggaacagaggctataacagaagtaaaaccaggttccttcatgttgagcttatagaaagtgtccttttgctttcattacaagattgcttttatcctccatgggtgataccatttcaagatggtatcagagcttctttctttgaagaagctctgctgcgcaattaccttccctttcctttttactgtcatatcctccatctatacatcatgagtgcaatacaaccacagcaagatcaaactcttaatattcacagcccttattaccttcatccaggagaaaatccagcaatagctttggtttctcccgttcttgactcatccaattatacttcatggagttgttccatgcttactgcactaagcgcgaagaacaaatctgaatttgttgatggtactattcaaaaacccacgtcaggccatgcacttcatacagctctgataccatcttgaaatggtatcacccatggaggataaaaacaatcttgtaatgaaagcaaaaggaagaagaagaatcttggaaaataatgtttctgtttatttattaacttctggtatatcgctgaaactataaaagtcagatatatatatacaacataaacagagttaaaataactaaccaactaactctcaattaactaactagagttccactactagttacagatataaagatcaaattaacaagctaagactattatgtaatgatacacaacggagaccaatttttgttgagtatcataacaagattttattaagatagacaatagaaattatttttataaaaaagaaaagaaaagaaaagtggccgatgagaagataaaaaagcgaagtgtcaatatcacggacctttgtattacgcattacgtcattagacccaaaaagtaaaatatgcatgaacagaaacaatgctttgctaagaaaacgagaatcatgtgtatgatagatgaaatttcggtcgagatttaacaatatatacttttaatacattttaaattgaaaattttaaatttgaatttgaatgaattttttgaaagaaaaatattcttaaaaacgtatgtttcacgattattttctaaaatttaccaaatatacacttacattttattaatttgataaatagtccttccatcccaatgaaatcgaattacaaacacacttgtgaaaataaatttctccaaatcatcagctaaattcacttggaatgtgtttggatagagaattttaattgagaaaaataatttattggagaatttaaaattatttaatttaaaattcattatttaaatgtttttatatgaagaatttaaatttttagaattttaaataattaaaaatgtgaaaatttaattttcttataaaatatgagaaattgaaattttcttcttctataaaagcttttaccgcaccactttttaatctgtctccatcatcgacaaaatgttcaaaattttaaaataaagaaatttaatttttttatccaaatacaaaattttaaaaataaaaaaattttaatttctttattcaaatacaaaattttaaaaattaaaaaaatttaataaatatattttagtttttctaaattttaaacttcttaaaattttaaaatactttatccaaatacattatacttgaaagtgtcaattcgatgtaaagtaagagtcggagggaaacaaattccaacacaaagggggcaaggatgggcctgatcactcttcttggtacattagtgtttagggggaagaggcagatacaaacctaaacggggcaagaatgggccagttttttctttttcaatttgtttttttgaaaaattgtataatatattattttaattgttttatataataatatataattttatgattaataattaattaatcatataaaccaatatttatattaaatttaagttttgttcttaaaatttaatatattttttccttttaattattctcctcagaagtatcgcatgaattctttactattaagtttattttattttcttaaacactattattttaatgtagttgttaatataaaaaatccgacctctttatactttttataatagttagaaaaataaagagagaaaatcaagattaaatagaaaatgaaagtgtataattatattaaaattagactttatattagctagttggatggttttttatgtgcaatcgaaacataataataggagtttagtttatatattagttaagaggtaaaatagtccaaaatagtatggagattaaaagtgagtatgaccattgtaatagttaaaggtaatttatttgccaattttaaatgttttatctctctttaatttttcttatataataaaataaattattaattttaataatgagcatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagaatatgttattcaacacatgtcgattaaaaaaaatacatcatgtatgataaaatttataatatgataagaagagataattgaaatgtgtttgtatatggagtatttacaataaagaataatttgtatatcattactcataaaaaagtataaaagttctagagtaaaattaaagaattgtaaaaaaatatcaataataaaaatagttaattaattaggttataaacgagctaaataagctacacaacttttttttaagttctatttagttcgaaccaattgtcatgaacggtgacaatgaataaccatctatgctgggtccttgtaaaaagatatttttacgttgctggacatccttcttttacatgcagtctcagccaatcatactcttcataatattttgacgaaaaaaattcctactaaaaagcattttcctcttccttaacaaataacaagccaagttaaaactttgcattagactgatttaaataaacaagacaagggaaatctaaacttcaaataatccacttaactctactcgtttaatttacacccttactcactactattaagaacctatcattttttcttattttttttataggataaatggatagttaattaagaacttatccttaaaaaggtgcgtgattatggatgattcccttcctcctttaattttgttcggttggggaaattctgcttttcctgttgcccccactcaatgggagtgggagatagtttctgtcttgtatcaacctgatcatatatttacgcgcatatgaatcatttttaattcttaatttgtgcttgctgagagcatgcacctgcgcgaatatgcatgtggtaattgctaataaaaacctacgtagtgtaaaatctacctgcaggtaagtgctgatatatataagacgtggctgatcataagaaacaccacaaacgagttcttgatgacactccaaaacacacacgtagacggttcttgtcatgcattttttgttgttggagagcaaataatatcgaaggatagggattttatgtcatgcattttaattttaattcaatcaattatgaaaatatcaacacattgttgttacaagtggaacgctcagcaatttcttaatttaaataagattttgattttttttaaactatagatattttttattggaaataattctgtttgagtcaaataaaactctttatctaaatatttaaaacagaactcaaattgaaaattcttattaaattgaaataaccttacactaattcatatacttgatgataaagtttcattttgagtcttgtgaataattttaaaaaaaatatttattaaaataatctatcagatttttaacatgcataatttaatcatcggaaaaataagtaataattatacatcaatatcatggtaaaataatattgtaaaattacaagagcttttcaccaaaataaatcaaatcaaaatatatagtaaagaattctatacttgcatgcctacaagtctataagaagcaaaatatcaatttaggtagctagagatatgccactattgttaatttatttaccctttgccttcaaggctgactctccaaccacacagacacgaatgtttctttgggattagagagggttaatcggctttactagagaagaaaaatcttggttgatttggaaagtcttgtgctgtaaattaaatgaccccatgggacacttcgcttatatagttgtaaagtacagaacaaactaaagttatggataaacaaataatgaaagcccttcttgcccacttgcaagacaacttgccattccaacaatctcttccaccttacagatcatatttgtataatgatgctaatagtagtaactatatataaacacagaagaagaaaagaaaaaaaaaagagaatattagagaggaggcaaagaacgccaacttgacattttttacactccaagttgagttcaatcaagccaagttgctatatagaggttggttcatatccaccatataaatttaatactaaagtgacgttgtcatctacacacatatatagtacagaacaatccttattgtacagaaaattaaagtccaaatcacgttcccttaatttaacatatataattaatgtaccgtcttcagggtttttaattctgatgttctttcttgactgatacgggatttaagtactatgctttagggctaggaaaaaaataattaagagaagcttcaacgaaacttgtaaccagccatgctcaccgtcacgcaccggctcacacgctgagaatggataagctcaaaaattccaggttacattcaacatttatgaagacttaggtggagaatataaacgttatcgaagattaagaagtctctaactgatttgggtttttacttgatagttacgtgttactacactttactgccggaagtactgtgtcttgtgctttgtttaactatatatatatgcatgtacatgtgaataaaagtggtttgtgatgtgtttaattatatatgcatgtacataaaaataaaattaagcaaatcaaggttattttggtaggtcttaagaaaatcaaatgtgtctatactgataaaaaaaatgcgtgcttagctagaataatttcaagttttcctataatatcttaaacttgttacattaattgaatctaaacactgaacatttacaaacattgccgttaaacacataaattgactctggattttaaaagttgcacaaaattaagtcataacaatcagctttaatttgaaaacaatatgaatattgacgattgtgataaacattcatgtgagatcaaaatgactaaggtttggaagactaaaaagaaagtgcagtaagttctttatattttttgggtacattaaacaataacatttttaccgtaaatttggtgactttaaaacactctctatggtcttttctttctttaatatttgtttggtttgtggcagatttcacttactaggaactgttcaaacttcacagcgctttatccggtgggcatatatcaatgacgaggaaaaataatgagtctcgattcgccaatagaattgttataggcaattagtttaattggaacgggaatttgttcaatttcttaatctccaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaataccattcttatatttttcttgatttccaattagcaataccattttttaacacatcttttattatttacaaaaaaatatttacaaaatagtataaaatacttattaaataaaaattcagattcacataatatcccgagttttaataattttaattagttaacaaatataaagagttcatttgacccatgtttttttagctcgtgaaaaaaaagagcttttgattaagttagtaagagtttttcacaatttatacagaacttgttcaactcatcctagaatactattttttttcccacttaaattccaatttgaatgtttcaccgattttccaatttaagtgtcatagtcttttgacttgtaccgaggctaaaggagtcaaacacttttctttattaagtttttaggcatttgtggactgtggttaagtttcatgaattattaattaaaacgacacatctattaaatatttttattaggtattaaattatttttaatataatttgatattatagaattttattttattttctaaaattattattgaccaataatatagaatttttaaaatattttatcaattataattaatacttaattttgtaattaatattatataaaaaaattgtttgtaaatcatatttaaaattaatttattaattaaaataatttttcaaataattttttaaatgtatatattttaataattttatgtatttttcttattatcactctaaacttatgttgattaaattaattttccataacattttttattcttataaatttattatttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatatcaaagaactccacaatgtggaagacatgtaattaagttggcttacgaacatttcttgcaagtacagaactgttgaactaaaacaacttcgcttgaacttaagttgcaatctaatttttgtgaacttactgatacttaggtttatgctttatgattgaatctgaattctccattaaaaaatattcaaaatatactgacatttttattatatttaaatatatttgttaagtgtaacataaggttttcacgcttgattacttggacaaggatatcccctacggtttgaaaacggattctacattgcgaaatataaactcattttgtatggtatggattttttttccgtcataagatatattatttttatattgagaggttaatattttttcttttttctgtttttctttcattctcattttatctttttgtcttcgtctcctccatccatcatcaggaatcaaactctgtcgtcatcatcaagagccaacggcagtgatcctaagccaaaacatgcaacaaatcaaaattcatgatcctagatcaattttgtttttaaagaaaaaagtcaaacgcgagcctccattccttccactttgtgcttccattcctttctcttcgtgctctgcctcttcgacccacgaagatagtcaaccgatgaaggccagtggtggttgcaaaggatggacagagatgtagtggtggcacaggtttgacaaaggtgcgatggttacaaagggcttcaattgaaacagttctgactagactcccccattccaaccgtcgatcttgcgcacctccttcacttttggcttcgatggcggcggaggcacggggcagtcggcgaaagattcgccattcctgtgatgcgatttccaatggtttgcggtcttcttcacgcttcgtggtgagtttttgtggtttgcaatggtgatgtggtttcgttcgtccttgaatttggttggtgcgatagggtttcccaatggttcacattaaacacttccagatgggaatttgaagaaagtgatgttattgactgatttctcttcttttctttggtattcattcggtttagtatgttgtttgtaaagagtaattgtgatgaactgatgatctcttttttctcctccatgattttttgttgtcgacggtggtgcatcaaagaattgggagtggggagaagtttctagcttagaaccactaagaacaaattgataaatgacagacaaaaaaagaaaaaaaaaattaacttatgtatcgtgcgaaacgagtttgtgtttcacaccgtagaatccatctagaaaactgtgctatataattataaatcaaattaaagactcattaattatatatatatatatatatatatatatatgtgtgtgtgtgtgtgttttttatgattgtaattgcagaggatcatgatcctttatgcatacatatatgatcagttgcaatcaaaattgaaacagttagaaagagaagtcataatgaaaggaggaaaatcgggacaagtaaactaatttggtcctatagctaatatcaacataagtatggcatttattcaaatagaaacattctcttcctcttctagtacataaaaaaggatttacaatattaaacaaacaagatgaataaataaaactaattgaccacggatacaacaaccgcagattcggtgcaaaagaagcactagcagtactcgatcagactcaccagctattagaatgggaaaaaaatcaaagaagagaaaagaactacatatattatatgtcacattcttcatttcaaccattgccgtctgaccttgagtcctccaaaaacaaatcctaatggtgttggtacccacctatttcaaacacgaaacataacccgaatccgtattcgaaacaaaaaagaaaaaaaaaacacgaacagataaaagaaaatgttcagtgttaacttcccatattttcagcgatctgagccagggactgcaaattgcaccgtacgattgtgtcgacgaaaacgcaagtctcttctttagtattaccgggcggtatgtcaacgacgtacgactcgatgacaactgtccctccgttgctgccgtcgccgtggagcgtggtgacggaccggtagttcctgaggcggtggtcgccgccgaccacgctgaagctcatgacgtggcgctcgtcgtcgaggatctcgaggcgctcggtgctcgacacggcggggagcccggagaccacccgcacctcgcggagcgcgccgacgcgaatgccgtcgttgccgccgccgcctcctgcggcgaccacgtggcagctctttacgaagtgcttgtaggcctgcgggttgtcgaagcgccgcaccaccggccacacggcggagaccggcgcgtcgatcgcctggatcacgaaggagcagcactgattgggccccaccgcgtgcgcgtggtgccgagcaaccatctccgtcacgctaaggcctactttcgccaataaacggcgagttgacggcgtcgtttgtgctggctttggacagttggcgccgtttgcgatggcggtggatgtgtcggttgcagggctgaatcggtggagttgaagagggcaagtcatatctagttcatgtaatgatgatagcaacaacaatataagtatgtgttcaaaacaaagatattggttttgtgatgttatgttaaagtggtttgtgcatatagagatgttgttgttgaatgagcaagcacatatatttggagggtgtgggaagatgagaggctagtcttgctttgtgaggttttggcttaatatttttgtaattcaagttggactttttattttattattatttagtggttatcttttaagcagttgaaatttatttaagaatataacatctcttaataaacattatttcatatatgtatacaaaacaacctaacttctaaattctaatcacatataaaaaaatgttcgataatatatcctctaatatatttttaaaaagatatattttcttaaacatgttatttattattgactaaaatttattaaagttaaaattttgagtaggtttcattttgttattcaataatttttcttttgattttgtagttttaataaattttaattaataataaaatatgctaataaaaatgtgttagataatattttgttagcacttctcattacattacatataagatgtgttcttttgtatatataaatgtaaaaattaaatttttagtcgtgtgtttaagaagaggagtaatagtaaaatatttttcaaggcattatttttaacacattatagaaaatggagtgaggtatattatgtaaaggatgatacttatataggtttaaaaaatttaatgaattttaattcatactaatagtgagtagtgtgttaaaaaaatgtataaggattaaaagtgatgattatccaattaaaaagaagacaccatattagtgaagttggagtggtttgataaagagaaagaaggagagggagggtgaggaagaaagaaagagaagggataattggtagtattgaattgtagcaggcggggaccttacgctaggcgtgcaagtggatcctcaacttgcaactgtcctttagactaggttttgtcaattataccattttttattcccaaacttcaactttgccactccacatattaatatttttttgttaagttgcttaaaattattgttacttaatccaccaaacttttctttggcctcgccgtcttattaaaagttaaaactatttttatttaaataataaagtgtttgtatttttatcgccattttgattttccttgttcaaatttgattgactctagacgttgctgtgtgtcctttttctcgtttctttcgtgtttttccttttgtttcttttggttcattttgtgtttgtttataaatcaaaactcaaaagccgtgcattaattcatagggcatctttggaaatagatcatgtttgaaggaacagtctagaaactccggcatatcaacaagttgatagtgatattgttcaagtggtatattatatatttagtgcaaatgattttaaaatcacaggatatttttcccgtgtttagttttgacgtaaagaagctagttggcatgatcgggaaatacacataaaatatatcatgttgtaaaagtgtttatatattttgttgaaaaattaatttctaatttttacagtgaaaatcatcacccaataaaattttataaatatcatatttaatcatcaagaaatcttaaataaatgtgtacatgttttcatggcgacaatgatttatctttaattttcttgcctttagccttttcttatgagttttaatcttcctcggtcattaaacctaattggtctaacactggtatccactcatttaccacatatttacttaataatctatttggacatatataattgatcactttaatttactcaatatatattaaatagcataatataattattaatacaatatgtaacacataataacgttagaaaatttaatttcctaacaatctccaacttgggctacatattgacctgagataattatatcgtatatccttagtgcgcaactatatgctatttatccttagattcctccttagatacagtctggtcaatctcttatatcaatatgagattatgacggcttttgtcactcttaggctaactaaaccttccatggttatcacaccaatatattcaacaacatagatcaaatatggatgagtggcatgaaaattacatgcaatgtgatctctaccgtgcctatttccaactaatccttctttagtctttatgatatcaatccttaattttctgcatacacaaagcagaaacacaagtacaaaataaacattcagggaaaaaataacatcaaaatctttattatgcagaaaataaacatataaatatctttacatagaacaccgacataaagaactcccactaaatcatagtgtcatcacataaaacaacgctcatatgagccatatgctcgtgaaagaccttaggcactatgcgtttagttagcgggtctgcaagcatagagttcgtccctatgtgttctatggaaatctgaccattctgaattctttctttaacaaccagaaactttatatcaatgtgcttcgattttgaataacttctaagaaaagttgttggagtacaacactactgacttattgtcacaataaatctttagtggtctttcaataccacttactacacgcagtcctgtgacaaaattttgcagccataccttatggttggacgcctcaaaacaatctacaaattcagcggccatagtagagaaagctacgagtgtctgcttaacatttttccaagaaatagctcatccagccaacatgtagacataacctgacgtggatcttttactatcttggcatccagcaaaatcagagtcagtatacccgatgatctctaattcatttgacatccgatatgtgagcatgtaaccttttgttctctttaaataacgcataacccttttagctgctttccaattatccatccatggattacttaattatctacccaatactcccactttgaatgctatgtcaggacgagtgcaaacttgagcatacattagacttcctacagctgatgcatagggaatcttttccatttccattgtctcaagtttattctttgggcattgttcgagattaaacctatctcctttagatatgggcgtatctcctaatgtacaatctttcatgccaaatctttccaaaatattttcaatatagctcttttatgaaaatccaagaatacttcgagaatgatcttggagtatctgaattcctaatacaaaagaggcgtcaccaagatctttcatctcaaaattcttagtgagaaatttcttggtttcgtgcaataagcctatatcgatgctggcaagtaatatatcatcgacatataaaattaggaagataaatttactcccactaaatttatgatatacacaattttccaccatgttcacctcgaaaccataagagattataacttaatgaaacttgtgataccattgacgagaagcttgtttgcgaccgtagatggatttctttaacttacaaaccatagactttgaatctccaaaaacaaagttttctagttggatcatataaattgtctcatcaatgttgtcattgagaaacgatgtcttaacatccatctgatgttgctctaagttaaaatgagctacaagttccataattgtcctaaaagcaaagttgtgaaaaccggttcggtcattgacccagtcgacgtagtgggtcagtgatccaaccggtgggtcagtaattgatccggtctgactcggtttatattaaaatttttaaaattatattatatataagtgtataattaacattatttgattaagaaaaatatattaaaaatttaaaataataattatagtattaaaattgataagaaaaacaagtaaagtgtattaataataaaagagagtgtaaataacaactatttaaattaaaacacaagttcaatttttaatttaaaaaatgagcaaaaaggagtacaaaaagaaaacaaggggggtacataagcaaattagtatctgttggcccatataaacctaaacctaaatcataatgatataaatagagcctgccagtacgttgcgctgcttctcttctccattagaccatttccgcttctctacaatacatgcagcatgttgtgccgattctccatttccacttctcttctccattggaccattttcgcttctctacaactacaatacatgcagcaagtcatatccttatttttactatatcttctccatttccgcttctcttctccattttctctttcaatcgacagtggtggagttgagtagcggcgacgacgtgcacaacccggtccgagtcctaaaaatcgaccggattttcggttttttccaaaaccgtccggttttctccgggcgaaactgggtcacatgcacgcacggttcgataaccaactcggctcagtcatgatactgaatcctggttgaaccggtctaaccgaccgagcccaaccgagtttcataactttgcctaaaagagtcttttgaagaaatcggagagaaagtctctttatagtttatgccttcattttgagtgaaatccttagcgacaagacgagccttatatctttcaatattacctttatgatgtttctgggggttttactgggtgatgattttcaccataaggattagaaattaattttccaacatatttttcataattgtattttaaaagagaatttattttgaaataaagccgtacaaaggtttaaactgagatttcattatttgaaaggaatgttatccttttactaaaatcaaatctttttttataacactaaaatcaaatcttaattactttaaaagtgttcaaggtaataacctcaagttgaaaggatttggattttagaagttaaatttgatatattttaaaagtgagctcaggccatattttgtgttattatcatataacaagttaataattattatgataaatatatgatgttataaaagtgtctatcacaataattattaatttcatcttactactttttaatatttttgtgtatgttagattggtttgatgaattgagtttttttttaaacaaaatattttttcaatttttgaaagattttgatgagtcaatttatcacttctagagtgacttgcctttcctcaaaaaagaaaaaaagagtgacttgcctaacacacttttcctcgttaaaaatatcaatcttttattagagtttgatttttcatttaatttactcatgcaacatttctaacattccatcaagtgaaacttttattgttggttctcatagttttcttccaaattttcaccaacttttgccaacttggatttttctcttcccatttattcaataattaaaccacgtacatttttttttgaaagggataaacataattagtccattatttcattatctaatatcgttacacaatcagaaaaacttttttttttcgtaaaaataaaattacatttataaaaagttgatgaaacttacactagataactttaaaagtcaatacatttttaataaagtaaataatttatacgtggtctttcaatcacaaattattatttatattaaatttacttattttataaaaatcatcttaattaaaagatatatttatcataattcttgttgtgttcatcgtataacaattttagaccaacagtataaataaaaattaaattcttatttatataaattaagatagaaatgcatttttattttggttcaattaaattatgtacttttggtttttgggttcctatataactttaagggaaaaaatgaataaagtccatgtatcattcaaataatatagtatatatctagataatcgcggtaaagtttttaaaagcacttggatgttagcaagttagcaacgatttatcataatgtaagtgccgttgcttctaattaaaaaacttgtgcagtattatcaatgtggaattatatatgttttcaaaaaaaatgtgaaattatatatgatttacacatataattttagctaatgttgtaactcagttgacaatgttgaatttgtagggattgacaagtaaaatatattcttgaaagggataaagagtcttgaatataattaagttctaaatcacttacagttgttattaataggatggaaacaggaaaaatgaaatacataaataataatgcgtgacaaatatgaaaaatattatatgcataatataatgataatctttcaaacaaaaaagatagccaactcttttgtagacctttcgtcgacgatcacttcatctgcaatctcagcaattaagcaattatgtaacataaggccattttcatgcaaacggctgtgccagcatatgcgtgcaattgtcacgaggcaattgctttctgcaccatcaaattgattttctgcacttttttaatctttcaaaaaggctattatgcaatgtgaaattacattctgaaatagcttttgcgaaatataactttatatttgaaaaagactaattttgaacgtaattttacttcattgattaggtaaaaaaataatcatggaaatacagaaaggaactgccttgtcacaaattaacccagctaatgtggtatatgatttgcatcagaaaataatatactatatattaatattcatttaattaaatgatcaaaataaaagttgttattattttgaatgaagattaaaaaatttattgaatgttgtcaatttcattttaaaaaaatgataaaattggaaggattacactacaagaaaaattaaagttaataacaaaacaatttataagcattttttatttatttataagagcgtcattaaaatttttgtgaccccaagttaatgacaaagaagcaattctcgtctctaaattatcttctaacatgccgataaaaaaaatttctaatatgattaatattttactaaacccacattaagagaaggatttggattctgaacgttcgagtaacaacttctttcctgctttatattcttcccgtatgcaattgagaaacattatgcattgcattagtcactattaatttatttttgaaggccaacatgcagacaaagagcaagtacggcagaaaattgaactatgttcatcctctggacttggctcaaggtatatcaaaagaaatttcgcttctcctaccaacaatggcaagtgagttcgggaagctgtttgattgttttgtagatgtaaggtatacgtgtagaatcatggttttaaatagggttctgcaacagtaattgcatctgcaatgtcaaggtattttaacttatcgcaaagcaatcgtaattgtagctgtatcattttcctgtaattacccgcagtataaaggttttctgacttaatataaccgcgattgtgatcgtaaattaaaaccatgatgtagatggaacaggaatttagaaggttatatttagctgaaatcgaatcttctgttatacaatcaaccactgtttgtataggaaaagatttgagttggtcagtactagatagtctgtgtttcattcttgaactgctggtatactaaccagaattatatccgcacatgacagtggcttgtttcttttgtaactaattattctctttgtagcacttcttgtgcattttttaaactattgaatgaggtattgctgagaaaaaaaaaaaactatttatgatttaaagaaaaatcgtttcaatataagcctatgctataaattacacattgatatttttaaaaaacaatttctcgttgctcaatatatatttgataagtaaatagccctacttttattttattacgaaattgatatgaagtaattctatcaaaacgaataattaatttttgttaaagaccataaacatacacaaaatgatttttttttttaaataattaaccatgattcaaatactgaatcacttaattaaggggtacaatccaactgtcacttatatcaatccctgttcttactgtaaatggccgtactagtcatcctattttataatttacaactgacataggagttaatcacttgaagaattaagaaaaagcttagaaataaaataaataaaactgattagaattcaatgccccttttttcctttttggtctcaataattcaccggtacagtattttttttttaagcagttgtaaaattgtctggaataaaaattttaattagctacttgattagaaggatctgaaaactaaatggatatggaggaagccgtgtcatacactttaaagaagcttgttgagaattgagatgtggggttgcgtcccttattgatgctcttgctgcttgggatggtcctgtgttgagcaaggtaagtgtgacttgaatttttttcctttaatttattcatttttaaaatatatgcgtgaaaatgagaaggttaaggtgcattcactagtgatttgaattgaaatacctctttaacacatttgcaattatacatttttaccttctcatttatccaagaaccatatttgcatatttaaaagatttgttaaacagtaacctatcagcttataattaatcatctaggtgtgaatctagatcagctgcctgtggtaatcaaggatgaacatttagaaatgtaccatatgctgaagaacattgtgtaaaatcacaaaggttggttaaacataatgcatgttccatccttaatttgaatgttatgatacaagcctaaatagtatgcaaattgcagacaattgcaaatgtaagagatttaatgcacataatccactcagggacaatataggatagataaagatgtttgattttcataggtaaaagagtatttagtatttaccttttatttgttggtagaagctttttcattcttcatgatcatatggaatgatttagaccggtcctccgcaaccatttccctgagtatatcatcttcaatcttctcagcttgccactgagaagggtcctccacaaaggcctcactgaagatcatgcttgaaacccactctttccaagtggttcttttgtacttatcttcctccaatgaacctgtcatcaagagctgataaacataaacaactttctgctgaccggggcgaaaggcacgggcaatggcttgctttgtttttgaagggttccactctgagtccaacatgatcactcttgaagcagctgttaaactaatgccttcagcacaagcagtgattgaagcaagtagtatctttgctactccaccaggctcctcaaacttgtccatcactctccccctttcaaacagctctagttccccagttagcaccaacacttccctaccttttgtccatccaaagtacttctcaaaatattccacaaataacttaacaggtgcaatgttgtggcaaaatataagaaccttctccttcttgacaacccgatagataaggctcaaaacaaattttactttggaccctattctcagatcaaacttgcatttctctagctccatcaattgcgccggagtgaaaaatttctcagcacatactgctgatttcaccaaccaaggatgtattgaacctagagttatcaaaagctctaactccagtgggtatccattgactttggccattttcttgtgcagtccatgcaaaatctcatgctgtgtatcagttgaattcatcagcaatgtataaatttgcaaaccaggtagaccatcagaactcccaccttcatacacatcaatgaaaccatttgtcacatttctcaacatctttagaccctgccgcctctccctaccattacttgagtcaattttcttagcaatttggtctaagaagaattttctagctcgcgactctaataaatgactcgctttctttgccactttccctttcctcttgtatttcgggtccaatgctttcagtacttcatgaataaactttggccttgccaagcacaaagtgttgaagtactcgcagaaattgttctgaaacaatgtaccagaaagcagtattctcagttctgtctgcactttcatcaaaacttttctcagcctagatttggtgcttctaggattgtgcccttcatccagcaccatgatcccggggctttccctcaataccttagccatgtatttcctgtgtgcaaacttcgaattctctcgcatcaatgttaaaaacgaagtataacccatgatcagaacactcgggtgtgaatgccatttttgtatcttctcaaggcaatccaaaacatgcttgacatcatcagtgggcttaggaactccaggaataaccatcgatgatttctgcttgaatacacggtaggttctacgaccatgaatcagatacactggtataggaatatcccacttgataaattccttgtaccaagtatatagtgttgtctttggagcaaggactagtggccttttccctgggaataacttcaagtagctaacaagaaaagcgatgatgagaaatgtttttcccgctccaggagtatgggatatcacacagccacctcttcttctggatgctgcttccatcaatcccgggtccatggaccctgcaatgttttgccaaagaaactcaaatgctttcttctggtgggcgtgcaactttactttaagttcgggaattaacacccaaacgttatcattttcttgagacacgggtttctcaggagagtcaagagctggcaagagattgatgtcatcgtcttcatcagccttggtcttggaaccttcttcagggctctgcttctcctcttggtgccgcactgaatgttgaatctacaataacaagaagttaatcagatacagattggggagatagacaaattatcccaaaacaggggaatgagcttaatatcatgtacaaattctatgatagattttgcaaacagaaaaaatatctgcctaatgcattatgcatcaagatggtgagttgatgcaacagtgagttagtagccttgtgagttgtgactgtggtcacatgctggatattgtattatcgaagaccacggtgtgttcatggtcctgtccaatttacatgtgacaattagccaagttttatgaccctttctcataaattgaacagctcagctacgtagtcatgtcacaagattacatagccataatccttgctttgtgaaggtattggggagggtcattgtatgcaaacataccccaggcatatgcaaaacaactgtttcaggattcgaacaaatgaccaactgaccaccaatacatgcatagaagaaaattacatataaattcacttaagagcaaacaaactcaaggagatttttttatgttttaaactacacttacaaaggggggtgtaatatatttgatctcagtgctcacaaagccacatctatagcagtaaattccaatttcttcattcattctgaaatcatgaggacaacctgcattcggattttccagagtctcagtgaaaacagcagcatttgaatcctgattaaatagttgaacagaattagccttaggaaaaacaaaacaaaaacaaataggggaaatcaaaggccaaattgacacatacctctgtgtcttcttctagatagcatgatgccaatgacacttccagttctctccacagcatatccatttcagattcttcttctgcatcctctttgccgagcacctcagtttctgtcttttgcccaatgctgcttggtgtttcgctttgcttccactggtcagcaatagctggttcttcattggttggtcttgtattaatattcttcaagtatgaatttatcaaatccttgtaggcagctgcatttaaggatctgtctttataattgtatctctttccttctccatgatctctacttcctaaatatgttgtgcggtgttttttccctttaactactttactggaaccaatcccttcccatttatttccaagattcaccatatcatccagatcacttaaacccttcctctgtgacttaggggcgccataactataatgatatctcgatgacaaatcatcactcttttctccaccatctgactttgcagcatgataatgagactcaaaagttaacaatttaatatccttcttctttgaagtggtaccagttagatgatgatacttggaagaaattttagaggattcattaccataacttctagtaaccttgtcatttagatcatcacaatgcataacttccaccggatcatgttgagcaggaagaggattaatagccagatgattttgatgttcattctgatcatcacctcctgacttcactttctgggatttagttttcttccttttgtacaccacaagctccctgcatgtactcatcttcttgaccttttgatgattgtcagtatccccttctagacacttcttttgtgaactaaacagaccggataatggtatatgcatttcatgatcaatatcatcatctttccaagtgtctatcttaactggtggtaagtttctaaaagaaccaacatcaatctgggaaactttttcgcaaccaagataacgttcaggttgtacattccgacgtttggaacgccgtaagccctcgacattgtaagatggtgattctttatcttcatgggattcctgttcaggatcaaccctcttggttttaagagtagctacttgagaaacaatgggtactaacatgcctttgtcagttttgaaactcacaacatcaatgtgagactcattgttcaatgaagtgctaacagtatcccttcccaaaacttgatacactagcttgtcttgtagagatcttacgcggattgaaaccttctttaaagctgtggtaacaactaaccatgaaagatcacataacacttttcccagaagcaatttagtgtgtgatataatggaacagtcctcagatgatgcccaccggtagtgctgattttcacaaggagtactttcaagtttttggaggatggatatttgattgattccaaccactttgatctccttactgagagttcttagctctgcaccgagtgaaccttgatgaacatagaagttgacataaaactgacacgagcactcggagtcatgaggttttctttgtacagagcttattttggcatcagcccaaacctgcattttaaaaaagaaagaaagtgtaaatccttgacattttggaaactaacattctcaaactaaaacagaggtcttatccaagcagcagcagcagcaacgataataataataagcacagaccaagtaatgcacgaaaaaaaaaaaaaaacaagaaaggggaaaagccagtgattgcctagttaatgcatacaaaataaagtagaaactatttaccatgtaaatgtgctctattttcttatcatctcacaaaatagatcttgaaatcaaaatatctctccaacaacgttgttagcgccgctataacgctgtaatgtggcattttttgacccctctgccatagacaatttgtgaaggaaggtctactatggcgccaccataagccacaatggcgtgtttatatggtggaatttccatcttctgccatatactaccattcactatattctgtcatccgtcattaataacattactctcaaacatataatttcatcaaataagtattgaaaaaagagttaaatatgcgtgcattattaatgtggcagtttcacaccatttgtcaataaaaaatgtcaactaatatgaattttacgataattattataaaaattatcaaatttaccattcatgcttgagaatgttaaatccgtgtatatattatttatccttgagaaagtgtcaaaataaaggaggaatcagagcatatctattgcataaataacacatcatgctcactccttctcataaagaaatttccgggcatagaaaaagttatattgcattgcccatgtgatgctgtcgtaaggcttgtagattctcccaaaaatgtcatgatttacagaattctagaacctcaaattaaacgtataaaattcagtgtaagaggaacacttacagggtcgagattaatggcatctgcatcatcagattgttgaggggcagatagcacacatacgtcaattccaggacgtagaaaacaggagcaatctgataaagtagctttccttgaccttatccgtatatctgacaagggtcctttatccataaccataagatgattatctataaaatgcatggacatagttcctacctcaatttttatgaactccacagcttgccatgagccaaatgcaactgcttcaaaggctgtttacaaagacaaatttgatgaagccaaattggttaaaagaaaagagtatttgctaaagaatgcaaaattgtgaatatatgattctggaaataatagacaaaacccacgttacaaaaaaattggtcaatcaagtttgtcctgtaaattaaagcctcttttgacattgatcaagtttcaaggcatgatgttataaattataattgattggtatttattcttttcattattttacttttcattggcattcattcatagtgatcaattgacccaaaaaaaagagagagagaagaaaggcttacggtgaggactgaatggatgcttgagttgatctaaacgcctttttctgtgtgccattgattgtgacagctaactaacttgtgttgtgagcttctgcagcagtgatttggcacacaaactttcactcacaagactgaagatttcatttcatatctgttcacaaaataaacaggctaatcaatgacatacaaattcagtggatcatatacatcatggcattatacatatcttccaaaagcacccaaaaaagagagatttatttcgtgtatgttgttttctgcctccaaaacataagaggaaaattgagaaaggagaaaatggtgtgcctataaatacgcacacaaacacgttcaccaaaagaaggagaagaagataaactaaaccaagttcaactgtctcatgttttttttcccccaaaaaccaaatcccccaacaaggaaagcacccttatgtgtcaacatgcagtgttagactgttagttaagagaagtagacacattcacacatgtgaagagttctacgcttcagcaaggaattatatactgaaatgacaaagaaaaaacatcattatctgtgatacccacttgtgcatacacagaaatggcaacagtgttatgttgcccaaagggccaaaaaagttttcttttttatggaaaatggttggttttgattaacaagtctccacagagaatccaaatattcagcaggttgaacaagtccatgatcagcaagcatagactttaaatggacttgaaaaaaatgcatgtatgtatgtatgtataatccatcatcaggggcatttagattttctgggaaaggcagaggaagcaaagagtgatgatactcaagtgagggaatctatccttaccaaagggaaaaagctggtgtctgtgttctgagaagaatctaaaacacagtttcaagcatcactgagaagagagagaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatattcttcattaagtaaaaaaaaaaaaaatcaactctatatttttcaaaaagagaattactattaacatagaagaattttatttttttaagaagctaaaataaagactttaccatgtttatgttacctgaatgggaggtaatgatggtgctggaattggggttgttgagcaagaagtgagtgcatggagaagtgagaaaataaaacataataaagtggggcgtgaaaaggtgtgaagtgtgaagaaaaagcagacacagacacagcatagcagtggaaaaatctattttatatatatatatatatatatatatataactaatgagttaattttatttaattattttttatctttatattttttagactattttaattttatttttaataatatttaaataataataattattaaaaaattaattatataaaggaaaattaatttattaatcaaaattagataatcatccacttatgattctctactttgatttggacaatgttagaagaggggtttatacgcggttaaacgcggggccataacaggtactagcttgtaacaacatttgttagtctactgaaccaaacaaaatagactcatgactcaactgaatctgacaaaagacaaaaatattcacatcaacccaatacacgtcactgatgtccacacttgacagtgttttacattttttatgataaaattaaagtaaataaataaaatattaacatagtccttaacatgatttaatatattttaagacattgactgtttattttttaaaataataatgtgattagtttattttagaaattaatatattcattctaaaaataaatatttattagaaatcattttaattaaaattaattatttttattattttaaaaaatagaaaagtacatcttttagtaataaaaaatgtttaaaattaaaaaatcaaataaatttgccttgactttgaatacttattttaataatataattattccctcccctccattataattatcatgtaagaaaaaaaatatgttctaaaataattgtcattttaatttttcaatgtaacattaattatctttttatttatatctcttataatattaataataaataataaaatctataaataaattaataataatatactattaattttataaaattattattctcttttatctatttattatctttcttcataagtataaaataacttaagataacaattatttttgagacagaaggagtatatgaatttaataagcttatattaggagtgtaaaaaaaatgaatgctatcaatcaattaaatatatgactttgaagataattattattttttactttttttaattatgatatttgaacgaagtagtcctctgaagatgacaatgaataaggtttaggtatggtctaataattcccatcctcatatgcattttaagaaaaaaaaatacatgtaccccgacctatacccatgtggctaacaggtctaatcctcattctcttactcactagatatttatatactcttacccacacttgcaactcctactttacttatgtaaaaatttaataaatcaataaaaaaatatgttaattaataattattataagtaaattgaaaatttattattaaataatccaaacatgactttaaaatgcatataggtggttagattaattaatttgtcatgaagtttaattttatttcaagactacccgtgacattaaatggtttaagggatgtttactttttaaagataactttttaaccaatgaatatgcattgctttgctaatagctcaataaatgcaccaattttcatggaaaataagtgcaaatcattaatcgatcttataattaattagggataacaataaattttagcaattaagtagtcttatgttttttataattaggactaagaaaatgttatcttttattttttatatataggactagaggcaatattaaaaacaaacaaacatgacattgatttgtccaaatttaactcataaataaataatattacaaatatcatcatcccacattacaaagataggtcattaaatagttataaatctacactactaatttgaagcatcaaacaacacaaaaaattgattcacaattgaaaaccattttcaaaagaacttgttaacaaattatcaaatttataaataaaaataaataatattttaatattcttaaatacaatgtaaagtaagtttaatataagggattttgaacaggattcattgttctcttttagattgttactattagttataaaattataaaaatatatatttttttataaaaaggtatatgtataatataaattatatgcttaattaacatattttaattacattaatatatatatatatatatatataacacatatatgtgcggtgcaggatgggacaacaagggaactatagtatccataactacacctatgcttgcaaaaaaattgcatgtaaatactcgtctccaccaacaagcggataattatccttcccgcttgcaaatacttttgctggtatcggcagggttcagatccatttttacatccctagtgactaatgtttgtaaaaagtcgtgagcacatataaggtacataattttctcccaacacgatttattttatacttaaggtcatgattcaattcctaaaccacttagttaaaaaaacataagtcactatcacttattttcaatcacattggtataaaaaaactttataaatcaattcaatgcatgcattaattatttttcatagtattaaaggttttttaaattatttaatgctagtattttattttaggtataatacttgtacttttaaataactaaaactataaaagaaattaataaaatatatcaaatatttattactagtattttcaagataatcattaacaattactattatttagcaaaaaaaataaaaatacaattaattacattaattaatgtaaataaaatattgtgaataatattttgaaaataccaattaatttttttattaaatatttttagttatttaagggttcttttggtgatcaaaatagaataagataattatcatgttgtaatccattatttgttatgataattatcagtattttaatttattttgatagaagagcgaattaagaagcaatattatagaataagccatttcctctaatattatagaataagccatttcctctctctctagaggggtcaaattatattgatgtaattttaataactattatactatttataacttgatatagaatatgatttttattgatcaaaccattgaattatatatacatattatcaaaattgtatgtgtcaaaatttatcaaaattgaataataataagaatataatcaaatgatctatattttagtatatcttaaaatgtttatattacgtcgattttaatttatataaatgagttaacaaatgattttggaataatatgaaattttgcatatgtaatatatgtgaaaaaatttcaatttaatattaaattttaagaaaatattatatagataaaagttataaaatgatataatagttattaaaattatactaatataatttaatctctctttatatatatatatataattattttttatcttctatgagaacaccatagaattaaattttatcttgcttttatcctattatattatttatcttattatattctatcatattctgaccaacgaattctaaaaatataaataattttgaaacttctaatattataatataattgatatgttattctctgtaaaaaaaattgttttgatataaaattattgattttattaaattgttaacgttttacaaatttttagtcttgttaattatttttgcctcatacttttatttaaaataattaaattttatattttcaaggagtatgagatttacaccttattttaaaaattattttaacaaaaaataaatcacatatacatttttattaaataaatgtattttaaactaaatatagtattacgacatagtatattttatattccttaatctatatatattaacattgaatattttccagtaaaaaaaagcattgaatatgttttgtgggtacaaacataaaaaataactacatattaaattaaggcaaatatttctcgaaaacacaaagcatggttaagggtgaggtacgtcgaccaaaaaatatcataagttaaaccaaaggctgtgaatgacttgagattggtaaataattgtttcattaactttcatagatgcccaagtggtggggtccacaattcagagactattgccttccaggctccagcagttgcactgttgggattttatatatgttttatgaggggacttgataaattaggatttacgaaattaaagaatttttttttaattcttatatgcttaaatatgaggattttatcatgtaaaaaaaatattatggttttaaataattaaggattttattgaccaataagttattcacaatgttgacaaagaaataaataagtatttttaattaaaaaattaacataaaatatcttagattttttgatggaagtatattaacgataattgtcaatatttttatattttaaatttcttaacgaatacttttaatttatttttttgatagcaagtgaaacgaaaaaagaatttagtactggagttgattgagtagtatatatgagttgctgtaaacttttagtactggagttacactcttacataccaaaaataaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagatcatgagaaaaaaaattcttgaaatatattgtgatgcagtgtggtaattaatatgtttgaaaatgactttattttgataatttgttcgtaatttgacaccaatttggtcaatcaaccaggaaaatggtgccaatcaaaataaaaacaaatacaatattagtcgtctctggtaatactatatatatcgaatgatgattctgtaagaaaagtatcattaaatatataattttattttaatttgcataattttatacatgatttaaattctagattaaaaaagtcaccctcagtatataatcgcttctagcggcggcaaatgatagttctataagaaagaaaggatattagaaaaagtaaattaaatatgtaatttcatttaaaattgtataagttcatatcatttagtttaaatattcgataattcactgcataatttcataccagcattagacacctagtaggaaaaagacatcgacgaagattggctctcaaaattgataacttgactcgttcacaaaaaatgattctctggtgtggtacatttgttgccttataaaagcatcaaataataaagacttaataactaatcagttaaatattacaactcttaaaggcagttggtatatctatttcccttctttgcttattcactcttttttcaatttatttttttaaaaaatacactctcatatttacttaaaaaaggagaatgaataaataaagaagggaaatagatataacaaatacactcttaaatgactaagcaaaatctgaggcacaagttagcccaagtataaagcagccgaggctcaggcccttactttatgtccacagaaaaagaaaagttatttatataaattttagggtttgtctaacacacacaaacacaaagtaaaaaaaatgagattaaacaatctcatctttaatgaccaatagaatttaaataattgtcttattttaaattctatcattaatacattgattatcatatttaatgcattatccttaatttctcctctcatttaatgcactatctccttaatttctctctgtctcattttagtcaatcttattaaatatgtcaattatttatatcatcatnnnnnnnnnnaagtaaatataatatatatttttttgaaaaaaagtgttatacttatataataaattaagtaaaaataacaatgacttatatatgatatatgctatatttattatataatataaatttttagttttacacataaataaattagatgagggagaaattaatagatcgagtattatgttaaatgtgatagtcaataataaaattcagaaaaattatttattctattggttattgaagatggagttattcaatcccattgttatttggaattaattagacaaatcctaatttttagtacgaataggtgaagacagtaacaagtggaatgctcgcaacactctctctaacattctctgttcaacatcttctttgtgattgactgaaatttttaaaattatcaattttggtgaatctaatatctaataaggagaaagaataattaaatgatacgtaagaccaccaaaattaataatttttaacaattttgtttaaataaagtttgtttaatttcaagcattttcttcatctaccaaataaactcgatcttcgaaaaatttataaaaatatctacaaattaattttcaattgggcaatgatcaatcttcccttttttcttagccatcaactctaaaattttatgaaatcaaatatctatatgtttggattgcctatgagaaactgaatcgttattaatgcaataacaaatttgttgtcgcaaaatattttcgtaggattttttgcttatggtacatcatttctaaaattcttctcaatcatattacctgtgtaaagcactggttgtttctaatattgttgagagtccaacagtttgcatttgtggcctattagatgactttggtttgtcatgagctgggccaagttttttgtcattttgtttttagttgtcaagaatcaccatcaacttcttttgggactttgaggaccaatcccacacgtatttctcataaagtttcacatctcgattaacaatcaacttctttgtatctgaattgcaaagtttgtgcctttgaatttatcttctagccaataaggatatgcatttttcttctttgttgtctagtttctttctaagttatctggaacatgagcatatgttatgcattcaaaactcaaaaggtgtcaaattggtggtctcctttcactccaagcttgtttaggtgtattgtcacaaacacgtttttattagacacttccttaaaataataacagtaatgccaactactttcgcccaaaactttctaggaatttatttggacttcaacgtacatattatcatttccatgattgttcttttagcaaccaatttggttgaggtgggtatctagttgttagttgatgtagagcgatggtgtacccataatcaaggattaaggttagctacaatagtgcaaagaccataacaaaaacgcgatatattttctttgtcgtaaaccatattattaaacttgtgagtggatttttgaaattgtaattatcatggttttctgatcttattttttattttatttttatttttactttttaagttaatctaaaatattttaagataaattatgtacatatatatatatatatatatatattctaatatttcatataagtttgtcaactatttcttataaaatacataatttagtcatttttctataattttctagatcctaattttatattattttattacttaaaatattacttaatattaaaaaattataaaactagttcaaccacaattcaattatgattagatcattggtcctttaaatcagtgttttcacctgtttgattattggtgtgattttaaaaatattgataattataaaacaaattgatctcttgaaattaagaaaataaaaaaatgatgttttaaatttaaattgtcaataaatttaatccatctatttgttggtgccaactttttcttttcttattattgttggtgccatctaatgttgttaaaacaaggcttagttgccatgttaagtgcttagtttgacagttacttaaactttgttcttcttttttcccaataatattggtcttctaattaacacattagggaactatcaccaacaaaactcctgaaaccaaattgtgtgaagcattcatgattaaattatggaaaaaaattgtaaccttgtcgaagcttgcatctttatgaacatgaacatgagtgttacagttacaatcatcaaaataataaaaaatgttttactaattaaaaaaatagagaacactcataaccagaactagatatctcgttaaagcataatattcttgttagaatctggaagagcattacgaagactatccaaaagaaattaagaaattttacaatggtaaaaatcaattttaagggcaaaaagacgaagtaaagagtcgttgaaatctcttcaaaaacataaaaaacacaataaatcaggccaagtctaatatgaagtccaaaaagcagggttcacgggtgaagcaggaaagtttactgttagatttattaataaaataattaacagacaagattattgacttgttaccgaatagccaaagaccttccttatcatcaactcttccccaccacccaccgtttgttttctaccggttacctcgacaccgtgagccgctacggcttgatcaaaagggtttctctctagtttggctagcacaacggcgctgctgcaatcgacgatcgccccctccaaagctttggcgaggtctactcgagacacttccacgaccgtgccgcaacaacttgttcatcgatttggtgcatcccgaggtcgtgcaagacctcacttacatggtaaactttggaatctgaacttcgtaatctcaaagcgcaacaaacaaggagattgactcggcaagtgccggggatcgttagagaccaaaacaaaaaagggtgatgctgtgatgttgggtttactcggcgagtgcggatactattagagaccaatataaaaatgggtggtaccgtggtgttggatggtggtgggtggtgccagcgtggtgttggatggtgtcgacgtggtgttgagtggtgcaggagagataaaacaacgtagttcacattagatttggcctcgacggtgatggtgatattgtcagaaagcttttatttattttttaaaataaaaattattttttaattatttttcaataaacaaccttttatcaccgatgattttcctgcctcacccatgaaccctgctttttggatttcatattagacttggtccaataaatcataagcgaagagccggagcctcactaaggtaccagttacaatagttataatcgtatacgacacgttggccataacaaaaatactgtatttattatagtaaaccatatcgttaatcagtaatcaccaattcaaagtctagaaataaataccgtatctttcaaacattagctttatattaatatttaaatttatgaatttcaaaaaaagaaattataatataaggagttgcacaacaaaatatacaacaactaagagagagaaaaaagataaatttaaatttaaaatgtaataaatgatattataaatgaaataaataaatacaagatataatgttatataaattattgtagtattatttctctttgaaaatatcatcacaataacttttataaccgagttgtgaaacataaataattaaactgtttgaaaaatgtaaccacaataatttctaaagccaagtcatgtgaaatttcaataactaaatgttcaaataagaatgtaacatttaaagtctacttcttcatgaaagtgctcacaattatgtgatagaagtgctcacaattatgtgatagaaagagagaaagagtcatgaactaaatcaaaacaacatacatgatcatggtttcatttatccaatgactaaagttattcatctattggtcatagatcaagaaaactaacattttcgtttctattggaatcaaccctgacaatttagtcccctgtaaccccaaatagactatgcatatccaattgaactaccaaaaaggacaagtataattataaataaagaacacaacagggacagtaaccaaatttagaatagttattatatatacattccactacttgttcagtttttatacacaaaaagtgagaaatgatataatatacccgaggtataatagttctccatggtacataacaaagaaattttgtatccaaatcagtgctcaactatagtcagccaaaacgacttcaaacagtctactcctcagctccacctatgtagttaaagacagtccaatttggatcccaaaaaacatgtaaatgaaaagaattaacaaatattgtcacagctaaattctccattttaaaaaatcttacagagaattagcatattaaaagaacataaacaaaacacatttcttgtattagttgtatagttgtattcctcttatgcacctatatatagctaaaaaggggacaacaacccaagagactgattactagcagatgctcgaaccagttgaaaatgaggcagatgatatactaatgaacgtagccttctctagtcatccttacttgcttgcatgccctttgaatcagggttcagatcatcatccaaattaagaaatcgtgattcttcccctccaccattataatcccctggctccactgtttttaagaaatctaatccataatcaacacctgaaggagtctgctccatattgggcaaacttcccaacaacttggcatctggattttgcaactgataaataaagcttgaaggtgtatcatccacctggggattaccatctccaggaaaacccatttgtccaaaatccaaaccttccatcaaggcagactcatcaattgggttattatctataagccccaaaagttcatccacctgaaataactcatccgtggaaaacctgttcaagtaatcgtcactaaaatcaaagtcatcaatccatgacaagtccatctgatctttatttacatcctctgcaccctgcccgatatcatgtgttccttctggtctgacatattgaattttcccagccccggggtacatgtgatccacagcctcatccttaggctcttgcttcattatgctagttggtgaggcagcttcataagccttatgacaatcattaaccttatcattcacattgacaagtcgaggattctccttaacatcctcagctgcacaaacctccgattggttggatgtagtactagtgtcagatgttgcagtttctgccgaagaacaagaggacgatgcggccattgaggattccttcaacgattccttaacagaagcataatctgttatgccgggaaaattgaggcgtgcacaaggaccatacatagctctagcagcttcatcataggcaagagcagcttcctgggcagaagagaaggtacccaaccaaagcctgcttcctctattgggctccctaatctcaccaacccatttcccccatgtcctctgcctaactcctctgtagttacactgagagttttgaggtcctcccttccctttcatgcaccctttcttcgaacctttagccggagcctttcgagttgttctactatcatctttgccagaataaagatgttcgttgtattccttccactttgcaatagtctcagccacggatctagtcccataccctctgctcctacttttcctctttctagaagaatccaatggcttaagagaaacttgatcataagcacccatgtcaacaaatccgatacacagacttcgcaacacagtacaccgcaaaactcaatcactgaattcacaatctgttagagaagaagaagaaaaaagcagaacccttcagtaaccaagagaacaaaacagaacacaaaggtggaaaagtataaagaggatttcgcaacacgcacttattagccatagtaataaattcaaccaagaaacgaattttcgtaaaccccaagtaatagataaagctaaaccccaagtaatagaaataaaaaacttgctcagtaagtttgtttttttctcttattttatatacacacatatatataaaaccctataaaagcacgacactgactaataaataacccagaagcagaaccctaaaaataaaaataaaaataaaaatttaaggaaaaccctaaacaaaaatcgcacaaaggaatttggagaatgagaatttagaaacagagttattaagacatgagaaagaatcggaagaatgctactaacctatgcgatactgacggtgtataatctgtgagagaacgcagcgtttttgggcttatctcttttttctagagagtgtgttctgttaggagtgaagagagttttggtttgagtaaataatagtagggttcttgttcgtgaagagagttttggtttgggtaaaaatctctgggctggcaccttggaatatctatttatagccttctctagatatttctgatatttttaattgcaccccagaaaatggtgacgtggcgctttcttagtcgcgttatcatgcttcggagtcccgaaccagctggcacgtggcgctcgaaccttcccgagccactaaaacgacgtcgttttctttatttttccgtcttttccgttatgtacctctctttttgcgtacattctcaattatgccattgctaaacctttttattttattggataaagataaatatcttgtgacgttaatctttgctatgattattattattatatattgagcggaataaatcgaaggttgcagtttcgtctatgttgctgatgtctggaaactgggcctcgtttaaacgaaactgggcccgtagcccgattgtacgagatctgcttgtttacctttaaattggactagtagctttctacataattgagatataaatgacgggaaaaataacaagtaagtttcggtaaattataaaattaactaaaagtcaaccaattttttttttttttaaaactaaaagtcaattttagaagagatggggagaaagaaattgatagttgaaacctaatttaattcattttttttattgttggttaaaatatttattttaatacgtaaaataagatgattttctctttccattcatttaacataaataaggttttcaataaaaataagaaaatagcggtaaaaaaaactagaagacactcagtgatgcatgtgcgataaaataatagtgataaataaccatacaaaataagcgttattacttttttttcttccttctaggcaagcattattacttcctatgttcaacttctttttttatgttgaaagatttttaaatctttaaacaccgtttcattgattttgtaacaaaaaagaaacaccgtttcattgattttagaataaacacgaaggaatctgtagaaaattccaaagtggtagataccaaccgaatcaggtttttttgaaaatttgaagcgatagatattagctttatccggagaaataaactggttttaattttaaactatttattattgaaatgaatatgtggcatacatgtaaagtaggcacatgtcagctggagaatggattctcaatataaaattacttttttatttatttcataaaatagctataatatttaatttttaattaagaaagataacaaataaaaaaacagttaattacaatcttgtaattcccgtgcatgtccaactccaagtagtaaggatcaggcatatcctgtttcctacacagaagtgacccatgcacgtgagacacgtacaacttttatgtaagggaatggtaacacgtcatttctgacttgcggtttgattatatccatatccatgagtaccaaacctaaccgtttgatgaatggtggttctaacttgtatgattccagccagtggatgagaaaattcctgttgactgttgtgtagcggggaaccagttcgaaagcggttaataaatccgttcatgaatgatacagatatgctgacaacatgaatccagaagtgttgagccagtgagactcgtctttgacaacgtgttggaatctttaaactttttcttctcatgctaaaacaaatatcacacacacggcttctggataatttttccagcgtaatcgttatccaaaacataattaatgggtttatttatttatatagttttgatatataacatgtaaattctattaagtattgcgaggagtacagaaaaatgagaggaaactttattacatggaagggcaagttaagaaggtaattttttttttgatgagtttgaaaattttaattgagtgaaaaattattgggagaacaatttaattattcaaataaatttaataggtggaaagtcaataggtgcattttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaagatgtagtggaatgtataactcttgaagaactgcgctatcataatgagaaggtaaatgtagagatgagacaatttaacatctataagtttcattcgtgaatggagctatgaacctttgtaatataaacaggtcacatgaaaaagacagattaccctggccaaaagcaagagaagagaggtgtgagaatgtgtgctcacttctattacagtgctaaaaaatctcgtcttaagcgtgtgctatcatttcattgtgtaactcttgagtgaaggtacctaagtttgtagaatgatttgggtgatgtatgttttattccaacattatgaaaggtcaaagaagaactaactttcaattataagagtgacaataatatcataaaaagaatgtaaaagaaatttatctgttttagcaccatttttaaagaggaagaatgaactaattgaaaaaaaaaagagatatgcttgtaattgtaggaaatatcgtgaaaatttgttcaaacgtagaattcaaatttagaaaataatttttttaaatagctcatgacctactaatgcattatgcccagaagtaaatgggtttgtgtaataaaagttttgcttgcaatttcaatagaaagaatgcagacttcaacaagaatctaaagatatagctttgtgctttacccgtttcctagctttggtcacaaaagtaaagagttggggccagaaagtttttgatctttgggtcttattccttaaattacttgtacagaatggactaaatataacttgtaacttgttcacagaagtatttatatttttttaaaactagtctagagcacataccttttagttgtatcttaaaaaatatatannnnnnnnnnnnnnnnnnnnnnnnnnnnnnnnnnnnnnnnnnnnnnnnnnnnnnnnnnnnnnnaaatatatataccttttttgtcaagcaattcatagaacaaacatatacaaaaaaagaattcgtggtcaatgaatctaaacgtacaaaatgatgtatgaatacgtgtattcctagtgagaaatcctcgctgcttattgttaaagtagttcttgttgtacttcatctacctttagtaaacaaaaacacactaaaaaatttgttcattatgtctcaagcaaacgtgtattgctagtgagaaatcctcactatttattgctaagtagttcctatttgataattgccaaaaatatttaaatgagatatgtgaatttagaccaatatctcatctcttttcttatctagaactttgtttatgtattttttatgttaaatttgtgactttgtagttatttctcttttgtttgtcattttgataggttaaatatgtttatagataaattattttattggaatttaaagtggattgaaaggcaacttggaagcaagaaatgagaaaggttaaagtggaaaattaagctgcaaaggggaggattttgcttaagccaagacaattttgtcttaaacaaaaacacaatagaatagagagaatacaaagcttcagaatttgcttaagctgaaacttttggcttaagcaaattttaattaaagtgtagatttttagagattttataaatagttgtgcttacctttgtgtacctgatccgtcttgctttgtaaaaataactcttttatgtaaaatatgattctttcttccactttctttcatcttcttccttccatcttgcattttgttactactcatgagaatgagtagctagatttttccatagctttgggttagattgtaactaaatcttatactttcatatattttgtttgaaatatgtttatatatgcatcttgttcttcaatgttagtgttttatctctattcttaatgcttgttattggaaaatactttcatatataacttgattttaggatgagattgtgattgaaaaatattttctttatcttgacttatggtagaatagtcattagctttcagagctaagaataagatgaaagtaattggttatctttggatcattaagcttaaagcaagtttttttgtcaaatgtgtaagaaattgatatttaatagaggaatttagattttttcactaaagaaattagggattaaaatactgtttttgaataacgactgatattaatattgaattttaagttggataatatgcttaagtgtaaagagagtttaatttgatgaaaatctaatcccaacaagctttttcatttgtattttgtttgcttttaagcgttcttattttaaaacctcaaaaacattttaaaattgtgttgctgtttaacatgttctttatctttgaatgtcaaattctatgttttaattgttttgtttgttagtttagatagtaaaaatttataaatttatcaaatattaagtaagtcctagtcggaacgatatctcttatttattaaatactgtttaacgacttgatatgtttggtaatgagtcaacactaatgtacaatctagatcatctaaatgagtattgttactgttgttggatgtcctggtttggttatgcttgattgttccctgatcctcctttgttagcatatccttcgtgtggcccttggtttgcaggtaagttcattttgatagttgattgtttgttagcatatcctttgaaacactacgagaaaattgatataaggtcaagtttttagatttttgtgctatggtcaaaccaaaaaatttacattttcataattatttaaatattgtttttcttataattttttttggtgtaaaactcatcaataatccattcataataaagattatttataacaaccatagttaatattattatataagttatcattaataataacatgactagttaataattcctacattatttttgaagcaaaacaaaattattttatttgccttatgacatagtaaatcacaaatttttgctgcataatttgacacataagctcaggggttggtcctaagattttttgtgccttggaaaaaccaaaagaattatgctatcataattatttaaatattgtctgtcttgcaattttttttatcaaactcaattataatccattcataatcaagattatgtaaagaaatgataatataaataattaatattattctataagttattattaacgataacatgaattaataatctgtacattttttttaaaacaaaaataaatatttaatctatcttttgacataatagattgcaaatagtattttaacattttaaattttgatatacttcttttagtaccacaatgacacatgaataattaatattattctataaattgtacatgcattaggaaaacaattaaatgtcttgaaagagctcaatttcatgcataaagtttgactttgattcaaatgttaaattataatatatataatgactttcaattctttaagatgggaaaaactctgatttctcggacttagtcacgcttatgtcggtcatcgtggaattggtctccgcatttgagtgctataaaattgaaaatcaagcgtagtgaactgcctctccgacaatctcctccacaatcagattacattactcaaagtgacgaaaaacactattacatcatatttgttcacgcttatctatgtgattgcgagctttgtcttgtcatttgccaatgcaacatccttgatcatcaaacacctcagactagagcacagggacaaaccgtgatattccgccacctcgacctcgacaaccatcttcgatctatgccagggatggttcatctccaaccatctcccagatcaccccattgcatttaccaatgtggcagcatcatgtaagctacctcatttgggatcttggagaagaggataaagctcgctctagtgaacatcttgatgcactatctccctttaatcttttgagccaaatttgacaaaagaaaaaagaatccatggatcaaccccatcatctctatcccgtaagaactacgagatcacggcatcacaccaaggatgccttggacatccaagagttgcagaccatccatagaatcctgtttaaaaagtgaaatgcattatccgctctaatggtcggagaaacacaaccactcattcttaaaaaccgatattcgtaagagtaaagagtcagtcaaaaaaaaaaaaggatgagggcaattctctgttcccagttctcctataattatatcatgtagtgaggatttctaccttttttgtaaagcaattcattgaacaaatgcatactacaaaagaatttgacgaaaaatttaatacaaaatgaagctgtgttacaattttttttttgtacaaaatacagttggagagacgtacgaaatgcagctagaaagacgtacaaaaaatcctagttataaaagtgtcagcctaccactgacacaccaaatgcagctgcagacattacactgagagagtcgacatctccaattaatacatcttcaaacagtgctttgtaagtacaagagattgaccagaaaacccacaacaactcccttttgggtctcttaaaaaattccttgatgtatttataagtaaaacaaattcaccctttatgttttcccaaaatacttgttatacttactattagaatgagatggtatgtcaattgcttactcctcaattgacattcctcaaccgggtcaaacatgtataagtatatttggtcgtctaccacaaaaagagcttatatctcaataatcacttcatcatttgtaatcattcaaactactattatttcataaatttgaatatatgatgtttaggctattcagtcttactttgatgaaaatgggtggtgttttaattttccaaaaccatttagtttatttatttattagacacatattattagtgtaaaaatatattttaactatcaaactaacaagaaattattcttactatgattttaaaaattaaaagtaacacattcacgatgtcaatttataattagataagtgcatgtgttatttatttttagtttttttgagttatgttgtgcttagtttattctttttttctgcaattttatcattttaagtttcaactttattctgaaaatatcttactcctaccatgttagtttatagtttgatgatcattgcaacatcaaacacagtactttcatatctgacaatgagtaaattgtgttttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttctttttaaacattgtattatgtttatctcttctgacacaaacacacacaaaaagacacttcgctttagaaaagatagggatagacatagtcaaaatcatatttcttaataacattaaccacatggggaagaaaacaaccaacatcaatttaatcaatcgggcttgtgaccatataagatggccttccgtgttgaaatcacaccaccgtctcttttaaacccgggttatctctatatgaaaagaacatcaaaataaaagcaaaaggagaaatacctccaatacagggaaacaacaatgaactaggaaaattttggaactgaactatggtaacaaattcaataattttgattttgattatcctaacatagaggcagatcctcaggagggggctcaatggattgcaacaggcctactccattatccaccaaaagcacagtggccaaaccccacccgatgtgaacatccaagtgacaatgcataatccaagctcctgcacagatcacatcaaccaattatatttcattaaacataaaattgggattaaactaatagattaataaacatctaatgtaaaattttacattatcaatcaatcaaaaattatttaatatatatttttttaatcataaaagttaataaatttacaatatgttttacagtttctactcatttacacttttaatgcataagaaatgattaaatagtcttagattattatgtgtccaccgtagtcctgactaatttgtatgtgatatttttttttttaataatattctattacatgtcatgtgatataagtcgagaccttccaaaacatgtaatgatttctctttggtgcaaaatactattttgatttaagctaattaattttacctgggttgtcagcaacaaatctgataactgcccatccattcactggcacagccacagtgttcctcataggtggatcaacaaggttgaacttggaagtatctttgttggggtcaaaattcccgaacccctcagccacgatgtagaaatcatacccatgaaggtgaatggggtggttctcaggggtcacaatgctagtatcctgcaacacaatctgcaccctcgatccaaacttcaacttggtcactttggtccctggaacaggttgccacagagaacgactcacattaccagtgtaatcaaacttaacaggaggctgcgtaggaaaatcagtggtgaacactccttgcactccaaggtgatgagcctgcaagattgaaacgttgtttgggagaacaaacgagacattgttcatgctggcagtgaaacgcgttccattcggtccctggcattggttcgcattgaaatttttcgggcaattgttgagtccaaggccaatggtgaagaaaagattgtcatcaatttctgcgggaacttcaacttttctggggcttcttaagctgttgctgaatgcagtgactgtgttggtgtcgttgtaggctgggagagacggcataacgggtttgatggacgagcctttcgcgggacacggggctgatttgtattcgagaatggcagtggtggtggtgttgtcaaagggtgcgttttgcgcggattggtaggcacgtgcggctatgtagtagcgtgtgggtggttggtcaccttggatgaggacatcggtggtttggcctggtcccagcatgatgacgttggtggtgaagggtttaaggtaggaggcatcggcaccaaccactgtgagcttgtggttggccactgtgaagaacaagggttggttgagtgctgcattgatcactcttaggaggtttgtctcgccagaatctattggaacaatgctggtgcctacaatattgccaattatcaacaaaataaatgtcgggtttgtgaaactactacaaataatgttctgttttcttagtttccaggatgcaggggtaaccctgtttcttggttcgaaagctttgtgtctagacaagttgtaaattgcatggcgatgctttgaaaaatcgtttgtttttgttcaaagaatacttattttcatgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattgctattttgttttaacaggggcgtgtgtcttttttaatatttatatcacattaagatattgagtttgttagtgtattagatgttatatttcaaaatcatgaattgttaatcaattaagatattaatttcatcacaaatttaaagttattcattaaaaaaagaggagtcacttattttgactgtatatcttttttatctctctgctaactagttatctctgccaaaaataccaatttccattcctctaatcaaaatatattaattaaatatttgattttaaattttgattttttttgccaggaagtttaatttgtctttaattactatttcctttttttttccaaaaaaattatgtgtatgaaatataacctttgtaaattgtagattgatatatatattaatcgaccaacatagatgtggcatgttgatgaattaaatgaaaagtaaaatatgatcaaaccttggctagaacacttgtaaagatcgccaggttgaccattgacggtgtatgcatcagaaatattaggtgctgctcctgtttgtgtagcttgtctcacaacatcgattgggtttgcgtcccaccactcccctaataatattaatcattatttacaccgtcaaaccatcttaatcatgtgcataatatttgtccaaggaaaaatggaaacaacaaatccaacaatatcattttcttaatcatcccctccacgttttcattagtgccatcattcccaattatattcatatatcatatatgtgaaatacaatcattaccaagaagaattggtgtctcgcgctttggcttagtgaaaggatacgcctctccctctctggggtgaatgattaaagcaccataaacagtggctcttagccatgagctatgagcatgccaccaaagtgttccttcttgtccttgaatggtaaaacgataggtgtaactttctccgggacgaatagggcactgagtcacaaattctggtccatcagcccatcctgttctcatttgccgaattccatgcctaaacacatacaagaaattaacaaggatcaacaaaaactaagtcactcaaacattttttccttcttctaaaagttccatatatatgcatgtagcatgcaatatatatatatatatatatatatatatatatatatatatatatatatatacacacacacacgagtataacgtgccttctataacttatcgtttggagacaagatcaattaaggcctttgttacatttaattctcacaagtgcataaaaaattaaaaagaaactttttttaagtatacccatgagccgtgagcacatgttaaagtatagaagttatctaatgctgatttcttttaaaagagaaattgtattggtacagaaattttgtagtaacgtaaagatgaaaagagagagaatattaaataagatgattgacgtcataagaaaaagataaaaggaagaaataatgttatagaaaatataatatatgaatttgttgtacgaataactgtttttttttataaaataattaatgacatttaataaagtatatttaatggtgaaagccgaaatgctaggttgctttgatacgataccagtgaatagtcacattgtaacgagctttgttagtgactttgacgaccaaagtgtcaccattgttgacttccaatgttgggccagggaattgtccattcactgtgatggtgctgtgggtgttgcacagcctcttcactggcgttgcttgaatctgtctcgttacaaatggcaataaattaattttcttagcaagaaagggacacaagaaagagaaagagagagaaaaaaaaaagtgagggaaagataacgaacaacaaactcatgctcctggattttggcattggctgaatacaatgctgaagccaagacaacaaaaatggctaagaggagggtcttgagagcttccataattcttctattgtgtagcaataaatacctatgtgccaatgatggttaaggttgcaaattgcaatggaagtgatagtgggagaaggatgcttttataggggagaacaaaggagagagcttgagtcattcaggttggcagattaggtaaactttgttatggcaaattggtcagaggcactcttaagaaacttaattcaaccctattaaagttgttgcacccactagttaattacgttcctgaatgcttgcttctcaagtcttcaatttggatgttgaattttctcaaaacatgattactttgagactgttcaggaatagaataatttattaagatgagtttagaataattgactccttttccctttaattggcatttaacgccgtacaattacatcctcaactttttcattactgtaaaagtattcgacatttcaaagggtccacaactaaaaagcatagcaaaaaggtttttttttacctttgctgtccaagtcaagttgtgtcctatgcatctttattgtcaagaagttaccatatggcctgaaatggtttgcctatagcaaactaacatgtaattctgtgcaagtaaacttgccccgtcaaacatattgcactttgtttttatctagtgattcttgttacttcggattgtgtattatttaattgtaagctaagtttggaaagtgaagaaaagtgcaattaattttgtgttagtccaatttgacttctttttttctggtttcggtggttggagaaaataaatcacttgttacaaagattgataatcgctttgatgaaaaagtaatagacattaaaaacaactatgacttctgaaaacatagtctgccctttatttagactaaaactctctgttttagaatgttatcgtcacttaaatatttccttgattgatctataattaagcattaaatatgtggaagaggctgtttcttaagctctcgatctcatgttaggctaattttctgtagggtataccctcacctcttttctttctctaacttttcaagtggctagttgttcaagaattcttatgttagactaaactctctgttttacaatgttatcgctacttgaatattgccttgatctataattaaccaatacaagattaaatgttaaagaggctgtttcttaagctccggatcacatgttaggctctctttagggtatgccctgaccctcttttcttctccaagttgttaagggctagttgttcaaagaacgctcatatgttaggatatttaggctaataattttgtttaattcaagtggctattgataggaaagaaactaacattaaaaatgtaaacaattaacagtgctgccattaggtacgtagcaaataaaatggggtagaatatcaacgtgatttgattgggtccaacacgaatttagttagagatactcatgaaaaaattaggtggcctgtctccctatatttgaaacgtggattatcaactgggaattatagcacaaaagcctgcagtcatactcaagaatacgtacttggatgtataattatcaatatatatcatcactttgactaacatcatcagggagtgatcaccatagcgccacatgttaaacaaaatatcacaggtgacgctttttcagatgtttgactatgtgatggaggatttggtttcctaatgatctgtttgttatgtaacgtattttcataataatatagcccattcaattattaaaaaaccaaatattaactaagtatactgatttctttcacaaattgaaaaatatgatgacaaattttatttggtctaaggaatgggttagatttgtctagaacaagacaaaatttgaacatggcaagtttatatatacttaaatgctatcttatagttgcatctgtgaattagctactttggacactcacaaggatgagaaccttcgatataaaaatgctttgacatagcaaaggacacgctaaaggttggacaagtctcttttagaattcgtggtgacacgaattcgtacaatttataaattcttaaatctcaagaaagatatgtggaacattttcctctagcagtattctcactctatcttcaatagtgcctttgattgagttgataacaacatctagccaaggcctcaaaagattattttggtttgtcacaaccgttacatgctgagaatgaaagcatgtcaattaatggaggctgagtgtgacaaagcttaacacgagatagagaacccaaatgaccaattgaataggtgaacaagaaataaagaaagaacatcatatatgaaagttggtagagtttgttactgactttctcaaattcttgagatggaaataataggaagtacttcaaaagtcgttaaacactgaaaaaaaaaaaaagaagcaagaaagcttaaaattgacacaagagcagaaaccaattccttgtcaaaatttgctggtgcttggtctctctcgcaatagcttttcatttgtctggtaatataattatttctcaccttctattaattcttgtttgggggtgtttgatttcttggattttcatggttagttataagtgggtgcgaacttgagcaattttaattccaccgtcaacattttctctaatccaaaataattagagagattaaagaaattaaactaaacagcaaatccatcatttcttcggtatagaaatggggccttcttaaagaccacgctcaaaatggtatgtttttcctttgttgtaaaatgcacatgtaacggtaatgaagccataaacacgagtttcggtgagagaataatccctacaagttcatcgaactcactataatgctgtatgaacttttatgtgcatgttccatgtgtgacgcatccagcacccctagctctattgatgtcacaaaagacaaaaaatttctctaggctggttggtgtacaatggacaaatcttatacacctagctattttgtatcacaagaatcgggcaggaattaatctcatctcaactttgttaactaactgaattgaaagcttgatttaactagacaccaattagcatgttttgacagactctaattggattagaataagggaaataattgagtaggaatatttgaacactccatgaatctaagggcgctgtttgtttctcttcttagtttttaattttaaaaattgcttgtgacacatcatattcaagtattcaacccaaaaaaaacagctttatttaaataatataattatttatgaattcttaaaattgtcattaattgtttttttttctctaaaaaaaacaaccaaaagaataacaaatggggaaattttccattgattattgtaccataccttaaagttaaagcaaattgttgaaatactttatccacgaatattatgaatgaaagagtaaaaccggaaaggtaaagtgcttgtaaaatactgcttttacatatacatgcaagaaaaagataaatggagtactgaaaacagaaggagggacgagctagcccagaggatgagcactgagtgagatcagcagatcgccaatatacaattaagcaaatattcatcattcatagtcattgtcaaaaaggaaaaaaaagttaaaaataaaataaaacaaaaggttgaaacataattgaggcctttgcacacatgccatccaccttcctaatgatatctcacatgcatgagtcacattttcttctttgtgaaccataagttcttaagaattgctggaagaagccaaaaaccatcattatcactactccaatgactcgtgatttgtgagttgtgtgtttgcactttgcatcgagcagatctataagttttacccctcttctatgctttttgtcttattacacttatctcttcacctttattttcatctatcactgtctttgtaaatctctccctccaaattagcctgatcataacggatatataagcatcttaattaagttcttaatagcagtgtcatctttatgcgttgtgacatagaatagaacattcaatgagtcaggcctgctaccttgtgctattatcatgcatatatgttcacatatatcatctccagaaattttagaaaaatcgcttctggtggattttgttctaaatggagtggagaaaagccaatttgactattagtcatatcagtgtgacaacttgccaaacaagtagaagtccagcaagtgtttttctctagcacaagctcaattatttagagtgacaaaaatcattcatgcccacttcatttttatttttccataggtctcttccttcaaagacaattctatttaagatatgatcggactttaaatgtggacatctctctcaactaggattcgaacctttattcaccattagttccttccgctgagcccaactattggttttcatgccccttcgctgattaatttccaacatatcagattatcaattcaaatccttttctttttatcgagtaattatcaattgaaatgtgaacatactgatttgaacactaagaataaatcgtagcagtacggtactatttattgagcaggtatatatctgtgataaagggtaacttattacttatccggttatccctatcctatttataattttgaatagagaaaacatatttattctaagtatctaaatccattttattgtaagttttatcaatgaacatatgcgagtataaatttttattctattcctaaatgagtagttataagtggataaaattattaacaattcaaatctgtatagtaatcttttgaataacttttctactggcaatcccaacatatgattaacattctgtattaggagtaactaatatcccttttaccacttttctttatcatggatgtactaattacttatgcaaaatgccaagtcaataaccaaatttatgtaatgttccatgttattggactaggcaggttgaacaaaaaataaaattggtcagcttcaacaaaatgttcataagactgtttgatgccttatcaatggattgttatacataacctcaacttggtttttatttccgttgtgttgcgggagggtaaacgtttagaaaacaaatttctgaattctgaaaaggtgagggattttaattagcaatttgggataccaatagtaatgcccatcatctttccaacgtagtgtggtttagtttaatttgggccccaacttgttgaaaaagaaaaatagaaaaccattgcaacaccgaagtaatgccatatcctccaactttgtaagagttcttagatgaggataagtgaacactgctaaactactaaactgtgacattaattaaaaatacgaaaaggaaaaaaatataagatgcagaagagacctgcacaaaatagaataacttacccaacaagaaaatgaggaggccacaccttcaaaaaaatcaaacaaaaacatttttgcttaatgcttcatctccgaagtaacattctttgaagaattattacactagtaacaagaagacaaatgtttcatttcaaatcggcattaattaaagtaaacaccttcacatgctcatcgtttgattgcccatgataaatgtactaattttctttctaagattctgtaatgaaaatgtcatatcctaattattgctatcattaagagaaatatactaaataaattcataaacctttagtcctatcaatgatgacaccctcaatagtaggggtgaacgtgagacgagttgagacttgagatgggataataaaaaattggttagggtcagtttctcgaactcaaaattcactcggtaaattaggaataagattgggttaattcgatttattattataatatatcattttaacattgtgtaaaattaaattgtaggataaaaaaagaataaaatttaaattaagatgtattttataatatatatttctgttacgactatttcctttagcccaaaataacataaggccgaggatcccgaccgaatattgcggatactaaccattatctcattaatatctaggtcattggttttcagcctataaataggagtatatctcatggagaaatgtacacatattctgactctttcttttccattcacacatagcacacaccacataccaattgtgtcgtgttctcttttgagtactttgatcatctttcgtgaggtgttttaccactataatcatcctcagaaagagagagtctgatcccatattaatcacccaacaattctcgttggacattcctattcatttagaacggaacaatttcaaaataaataatatctttataaatataataccatgttatataaaatggtatccattaaatataaaaaattgttaaaattatatatatttgttcaaaaagcttagattttttaaataggaccgggttagagtaacttgaagaacagtttaacttcgtcctcaaaatatactgagtttaattttgaaaacccaaacttgtccaattcaatttatatagcactattttcttaagagagatttatagtagattttttaaaataaaatgaagagagaaacaaagaatgaaaatataaaaaaatgcattaaaagaaattaaatctctgacacatgtcttaatatttaattaactaatttgtttctgtccctaagaaggtgtgatttataagcttgtttgccttttcatttaagatgatattgaatttgaataattgagaaaataggttataaagtagatttacacacagactgttatctttttctttcaacttaaatatactttaactatcttatataactcaattgataaataaggatatgaattattataaatcttttaatatttgaattatttatataattgagtagcataatgtgagtttagactatcttatgaataaaaaaaatatattaattgatttggggttagactatctttcttatctctcatagttaaaattacaactttgtttcataaatatttataaaaaagaaaataaaaagataaaataaattaaactttctcataagttaaaattaatttatatatttaatttttgtaaaagttctttcatttaactcattcaaaagtttaagttatgggtgaagtttaattttgccattacaaaccatcttccttttatctttatctactattctttatctattttttttatctccatttctagattaaattttaatataggaacaagttggtgggttaagtggaattaatctcgatttcttttggcaaagttttaaagttaaattttataaataaaaaaaatataggaacaacaaactccacaaataattacacaaacaacaaacataaatagtcctaaaaacaacaacaaaaaacctcagaataaaaaataaccacacaagaaaagaacacttgttagagtatatttgaaaatcagataaaaaaataagacaaaaatactttcacaaaataatccaaacagaatctttatttttgtttttatttttattttatctattgaatttgtattgaaacgtaagtcagaatatttttaattacaatcaaacatgtaaataatccatctaaaaacattggttttggttgttccaatggtttggcttggcttctttcgtatcaaacgcgtgatacacaagacagacgcgcttctcttggtggttagattaggtagcaccggaagccattccttggccccattccggcattcctaatcctatcatattttttcttacatgcacgagttgactcaccaactcgttcactcttcccttacactcatgactcaactctccttcttcttcaaccttccctcatcatgattttcaattctctttcctcataaccagattctccaaaaatgatgaatcacgattccaacaacgaacaacatcagattctccatgtctcgcaggacgacgagataatggaatcgctaatcctcgatgacgacgacggctcttccgttcagcagcaccaccgtcctacgtcgccgcagagccctaattcccctttcaactcgttcctcgaccctccctcctacgccgacgcgatcttcacctctttcgattccaacggtcacgaccaagccatcgaatcccccgccgcccgatccggctccgaagactatctccacatctccgtcaccgatcctgagaaggagcaggacatcgccacctccctcgtccccggcgccgccaccttctacacctacctcatcaccacgcgcaccaacctccccgaatatggcggcgtcggtgctgagttcgccgtccggcggcggttccgcgacgtggtgacgctctccgaccggctctcggaggcataccgcgggttcttcatcccggtgcggccggacaagagcacggtggagagccaggtgatgcagaagcaggagttcgtggaacagcggcgcgtggcggtggagaagtacctcaggaagctggcggcgcacccggtgatcgggcggagcgaggagctcaagttgtttctcgaggccaaggggcggctgccgctggccaagaccttcgatgtagcgtcgcgaatgctcgacggcgccgtgaggttgccaaggcagctgttcgggggagaggcggagctgggagaggtggctcagccggccaagggcgggagggacttgctcaggattttcaaggagttgaagcagtctgttgccaatgactgggttgggagcaagcccattgttgtggaggaggataaggagttcatggagaggaaggataagttggtggattttgagcaccatcttagcaatgtttctcaacaggttttgtgtttcatggttttagctttagtgtttgttagttcaccatggtgcattttggcaatgagcttaactatgtgcttatttagtaagttcatcataagattaactatggtgcatttgggtaatcagcttaactaagtgcttattcaataagctcattaaaagtttaaaaaatgagcttaactaagtgcttattcagtaagttcattattagctttgggcttccatgttcattagttgagtgtggtgtacttcctctagactcatatataagcaaaaaaaaggtcttgtatgttggacttaaatataagcaaatctaattaattttgtcttatttaatgttattattcgtacaatatccttcatttaattctaattctatttcagtgactcctttttatttatgatagtaatttccaatgaagggcattttagaaataaccttattttttacttgagattaggataattaaatgatgtcaattaactttcttaattagtgtgaaattaattatttttgcttatatgagtccagagggagtatttgggtagtgagcttaactaagtggttattcaataagcttacatggataagatttagtgaacagtgaaggttattaaaagaagttaaagagtttataagaagctttaagttgcttttgagcttaacctaacacctgcttaggcacttaattataagatatgtctaaataattctgtaaaagtacttccaaacactctccgaatgcatgtttggattaagcttattctggggggaataattggtttttgatagcttcttgaaagagattttgaaaaattatggttacttgattgaattgacaaacattcctcttcaagtgttgctgtgattattgaattttgtctaaaatgtgcccccctatttggaatttagataccatgtccatttttgtcatgtggaactgaataaggacaatgttgtttttcactttcgcattgccaagcttgattttgtttatctgcattgacctgcaggctgaatcccttgtcaagtttcagcaagacatgggtgaaacggttggtgaactaggtctggcttttgtaaagcttaccaaatttgagacggaagaagccatatttgagtctcagagagttcgagctgctgacatgagaaatgtggcaactgcagctgttaaagcaagcaggttatatagagagctgaatacacagacaatcaaacatttggcaagtacaaatattcttgtgacttatgatagaaccttttagcttctttataaatgtatggtggaacatgatgatagatgcgttaacctcctgatataatccctaactattttctgttgttgatgagtagtatcttctttatgttgcaggataaactacatgaataccttgggaccatgctagctgttaacaatgcattttctgacagatcgagtgcattgttgactgttcaaacactctcatcagaactagcttctttacattcacgggtggaaaaacttgaagttgcttcatccaaaatatttggtggagacaagtctaggatgcggaaaattgaagagttaaaagaagccattagagttactgagaatgctaaaatttgtgcagatagagagtatgaacgaatcaaggtaacctttgattgggttgtcctctcctttctttggcatatgtaactttgacttttgagcttttatccccctgcatattaactcatttttccctttcagaactgacttttccatattttctttgtcatactatataatgcatgtctccatatttgtcatatactgtagatttttgtctttatttgcttttgttgcatgtgtgcagttatattaatgtaggagaagattttactcaacataactcagtcaatgagtttgatatagtatagtcactaaattttgaacacccttacatcccttgtggaaaaatgacgagatcctattaaattatcataaataaaaattagtattttttcactttgatgataaatttgactctaatattttcactggattttcttgatgcctataatgcaagtgtatttgtagacaagtgtcagggtgaaagaaaaaaagactataatggtggcaaagctatatgttgttgcacttaaatgtttcatcgagggctgcttcttccattaataatgtcaattcatagcacattttgtaacattcaattttgatttctagatctattgccatctcaatatggaaaatccaatgtttttttagatcagactaatatcattgaagtagtgaagacattattggctcatggtttactagtcaaaccatggttgaatggtgataattagataccatttttcatattatataatataattaataaattaacatacaatcatatgaaatcagattaggtaagttttaaattaaaaggacaaaattatttatgtcttgtagaagcaattataagaggttgaataatcatcatcctgaaaggccacatggaagcaaaggatgaccattatattactcaagagcctcaaagtcctacattggacatggagtaaaacatcaacacacacacacacacacacacacacacacatatatatatatatatatatatatataataagagataattacatgaacctcccttgaggttggcggtagttacccttagatactgtttgtttccaaaattacacctacctcccttgtgtctcttgctttgttaattttaagataacgtgcatggtttgtacttaagaataaggaggtatttgtaatttttaaaaataaatggtctttaagcataagaataatatataaaataagggatgtaagtgtaatttctaaatcaaggaaggtttaggtttaattatcactgacttcaagatatatcagtgattcagtgtaaaaatatccctatatgcaaaatataaaatatatattataccccacctagtgggattagactttgttgttgttgtatacccgacgaggaagctttactacaagtcccacacagtatagtgagtggaatattcaggcatacaatatatgtaaaggctgatgctgcattcggtttagaggatagaaatagagaggatggaaatagaagacaaatatttgaattaaagtaaagtgtaaaagatatggaacccacataaaaaccacattatttctcccctctttctctcctcccctcaaagggtcaaacaaacacagcataagaggtaggcaagtcatttcatgtctaaaatatagcgtaagaataatatttaaataaggaatgttagtgtaaaagatgcgaaacccacataaaattcacattatttctcctctgtttctctcctcctcccctcaaacaaacacagcataagaggtaggcaagtcatttcatgtctaaaataaggaatgttagtgtaagttctaatcaaacaaggtttaggtgtaattacccctaatttcaagagagatcagtgtaattatccctatataggttttgattgctccggtttgatgcactgagtgaactggacaagggattggttcgctggtttttcaattggtctggtctggtcatgttcttgttcatgtctccatatttgctttcatttcatgtgtacagttatattaacctagggagaagatttgattcactaaactccttttcaccccttatggaaaattgacaatgcgatccacttaaaatatcctaaatgatcataataagaattatcatcattacaccttgataataaattaggcttgttatctataacgcaagtgtatttagagacaagtgtcagggaaaaaacacacagaaagagactggaatagattcaaacttgatttctatgtccattgtcatctcgatattgtaaaatccaatattttaaaaactgggtttgtgtggttatggttcactggtcagtcggatcattgttgtgaaatattgctgggaagtctttatcatggaatattgtgtcaaaatatcacttgtgatttggaatgtttgcaggaaaataataggagtgaacttgaaagaattgaccaagagaggaatagcgacttcctaagcatgctgcgagggtttgttgtcaatcaagtaaagctcatttatcttctatgttctgtaagctgttacgtttaattggcttttatctttcgtaattcagaacagttactattctacttcatccattttacaggcaggctatgcagagaagacggcagctgtgtgggagaagcttgcggaagaaacagctgcttactcaagagacagcagctaaaatgtacttggctgtaaattcttgtttttgccttttctatgcagtaattctagattttggttccattaatacaatcttatgtagttaaattactttagacgaacttagttttagcccagagttgtatatgcatatatccttttatttttgtcctacattcaagatttcaatgagtttaaactaatcagagttgtacatttcttgcatatatctttttattttcatgttataaattaatgtttaatttttgttgtggacgcagctgagtatctaacccttaatgttttccttagatttattggagagaaagtagaaagaaaagttgacttgaattcataatttacttttttcaatttaaactataaaatattttctcctcccttacaggtctttagttttaacttttaatccgaattatatatattcttttattcacatgtcatatatatcaatgttgattttattttttttgttatggacctacgttgtccttttaaagattgacttatgttaaaacgcattaaacttggacatgagctatttgtgccgttgatttcaccgcagcaattatctacgtatgtgacgaaatagaattaacgcaaacgggggagtttagttggtggagaacaagaactagtttctattatgaaatgaaactgatgaagtgttaaagataacactcgctgaaagcaaagtactatgtacaaacactaggcactccaaacaggcaaaaattaatgtaagaatgaaagaataatagattgtcctacctacactacactacaacgttagtcctaaagagaagcgtaaactcaaaaattgtccacataacacccaatattcattcactagtcgaagggatggctccatcgtcacccgaactgactgctgatatctctggtctaatctcttcaagctgctgaaggacttgctgaacttctggtcgtgctgatggagaaggatcaacacagtgcaaagcaagcttcaacgtgttcagcatctcatcgccgtatgttgaagcatctctcatcaactctacatcaaaaacctcatttgtccactcctctttgacaatggaggcaacccactgaggtaaatccactccattcatagcctcaccaggtggcttccccgttaggagttctaacaagatgacaccaagactgtatacatctgtttttgtgttggcttttttcagcttcgagagctcaggtgctcggtatcccaatgctccagcagtggcaatgacgttagaattagcagcagttgtcatcaaccgagaaagaccaaaatcggctattttagcactcgcattctcatccagcagcacattgctggacgtaaggtttccatgtataatgttctcactggaatgaaggtataacaagccacgagccattccctgtgctattttcatccttgttggccaatcaatggctgtttctggcccacgggctgcacaaaaatggaaaacagtcaaaacaatagtgttaagatattaaacaaatattctaccatggaaagaaaaaataatcatagcaaacttacaatgtaggaaagaagcaagacttccattaggcatgtaatcaaatactagaagcttttctcctttgggtcccaagtaataggctcttaatgccaaaagatcggggtgtcgaattcttcctataacactaacttcagattcaaattctctttgacctttagtgatcttttccctcaatcgtttcactgcagcttgacttccatcctctaatgtagccttgtacacagttccatatgtactctttcccattatctctgctgttgcacacaagagatcatcagctgtaaaggtcaatggtccatcaaaatggactagtttgcctccgacctcgccacccgcttcggctttgcctgcaactggaggaactcctttttctgtcatggcagcagctgctgcagctgctctacctgtggcctggccaccctcagcatttgatgttgctctttttctgatcaagcagaatagcagaatgcagcaaattgttaccaggactacaagaagcactcctgctactatgagaattatgtctttggtgcctaatttcttatgatgacggtgttctgatatttcgggaggtgaaccagaaggagctagggagggacatggggttgaagggctatagccacatagttgaatattccccacaaatgagctcgagttaaatttttgggcaagtagggtgggaactggaccagagaggttgttatgtgaaacgtttaagaaactaagactatgcagattatcaaaggcgactggaatttctccactgagattattcagtgacaaatcaagctgcgtaagctttgaaatgtttccaatattttgaggaatgtggccactaaattggtttctgctcagaactagaacagaaagattatgcaatctgcctaaggcttctgggatttgattgccaaggtggttgttctctacattcaagagagtgagtgaggaaacattagagagagtggcaggcaagcttccattcaagacattgttagaaaaatccagagtctcaagtctagaaaggtttcctatttcatttgggatagctccactaaactggttatgactaagagaaatctctgtaagttcactcaagccgcccaaagaagcaggaatgcttccactcaacatgttatgatctatgatcagatttcgaagccgaaagaagtgatttttcaagctaccaccccatgagttaggaatagagcccgagaggttattgtgttgaagagataggtaggtgagagaagttaagcgagtcaagctagttggtattgggccagacaaggagttaaagctcaagttaagccaataaagcttagtggcattcccaaggctcatggggattgtcccagtgagcaaattattgctgaggtccaaagactgaagcaaaggacatgaccctaacgaaggagggatgttccctgtgaacctattgttgaagagctgaacccctcttagattgagaagaagtccaagtgctgaagggattgaaccaccaatttggttatcatgaaggctaagctttctaagccccctaagttggccaatcctctcagttatgtgacccttcaaccccttccatggaagctggatcacaatgacctgtccctgagcacacttgatgccaacccaagctccagaacaagctccatagccactgtcgttccagcttctcaagaagcctttgggatcaaccagctcttgcttgaacgcttgaagtgcttggaagtttgactgtgtcacaaccaccccatcccaacgctcttcactcaccactggcaccatgagaatccacaaacagaaaaacaaccggaaaaaatgacttgggttgtagtaaaaaaaacattttgaggtcaggttcttgttctccattgcaaacaaaatgaaatatttttaaaaaaaaaatagtaggagaatgaatgaagcaagaaagaagtgaagagaactaaagaagaaaaagtaggagactttgattgattattacttggtgagtcttcttcttctctctagtagtagtagtgtccataagacacacactgtgattggtattgtgagagagaagtgggcatagaaaactaaaacaaagaggaacaagagttggctgaggattttgtaggaatgggaagagaaaggaggcacgtgatggtcataagagagatagtgtgagtggggcgcgaggggtaaggaatcttgtgttgggaagagagagcaaaaactgaagacagacaattatcaggtgggtgtggtggtacagtacaaccctccctcttgcttcttgcaaagacaaacggctagtttttttttttttttccttacaactatgcacatttatttgttcttttcttcaatgtagatgttcttgtctgtccgcaacccaaagtcccaacggctatttcttcttcatcttcgcagtgtaggcccaccccatttcagctccggaccgcaaaactacaaaatgctgccaaattactcacttacccctcacgcttcacctgactacgtgtggatttggatttctggtacaacttccgttttccagaagcatcagactcttgcttttgtaaaatggagtttatcaaccattagatttatcttgaaatttatgcatcatattttgaatgaacattcaaacataccttacatgaatctgatcaccctaaagttaaattaagactttaatatgtttttaatctatgtaaaatttgtaagttttgattttagtttttataaataaaaaaattctaagaaaaacggaataattaattttagtctcttactattatatgacattttttaactgtttatctatttaataaaatatcaagtgactatttaggtaggactgtttattgtagtttttttcttcttctaaattcctaaaaaaaatagtaattctaaatttcggagggataaaagtgaaagaaaaagttcttatagagaccaaaatcaaaatttccttattttataaagataaaaatagtaatttcaaatttaaggaaaataaaaaaataaattttttatagatacaaaaattgaaaatcactgattttaaaaggatttataatatatttaaaccaaaattaatttaagataaatgctaaaacaatacactctttaatacattttccaatcatatttttttaatgattgaaattcatgtaggtctcattaaatgagtcatatttctcacttgatgggtcacatcccgaaattagtaagacacatggaattttatcaatgagcgttgaaaagagcaagttactaactctccacttgatttaaatttaaatggtgaatgaaatattgtaaaataaataaatctaaatcttcttacgttttatagctagtcctccattgtattgtagtaattaaaattttatattttgaagatatcaaatttatttactatttatttaaatttttaatagaataaaaagaagatttgctttccttttgatttatattgaagagaaataggcctgttaaaaaattctagttgggctaaacggttcataactgaaccgggcccaaatatcaattgtccattcatgatagctcgttcacgttacctcgttctgcgttctccttcaacacaaccgcgaaaaccttaactcagagctcgttcaccatacctcccaaatccattgtccaaaatcgcggctcaaaccgaaaattcgaacttgaatcaggtatcgattagaaatctcgttgcaatttctgattttctcatcgattgtgattgttcttacatgtttacaaactgatagttcaacttatactgtttgtcatatttctgttcaggaattttggggcaaggttgctaatgttggcaggattcaggattaactatagttcaaacctagtaattctcgctccctttgattcttcgcaaacttattctaattgttttgtgattttttttttcaattcagcatttgactctgtaggttaatattattgtttgagtgagtttgcttttttgatgtgagatatggagataatttttctgtatccatttacagtttcaatgttgcgatatcttggctcatgttatagttggcatttttaggtttaaacttaagagaattaggtacattggatgcagaattaatttattgtttatcataggaggggtatagaaagagagggaattcataattattggtaacttggcatgggaagtcatggtaaattggtaatggcaactggcaagcaccatctttctttaggctttagtagatttgccaaacctgggctttgaagaatgggctacaagcctacaattggactttcaagccaggtaccttagtgtttttcctctgtctttttggcactaaccacttcttatcaaccttcatgttaacattacatttcaacggatgaaatgaccatggtcttgaaagttaaaaccaaaaggaaaagcaaagtaatatctgtattgcctactagtatacaaggtagaatttaccttgcctactagtaacaacttacgagcttttttgatatttgataataataatatagtctgcataatctgcattttaatgtctttagttgttactattggtaactggcgtgcattgttgtgtgtgtatatacagtcttcctgttaatgcatatagccacccatttaagatgtgggctaattgtttagtatgctggttctaacccactggtgatggtctatattgacagcaactaggtttcaaaaactaatctctaatctgtatattgattattgaataccagatagtagaagaaaaggaagttcagctggttttatttgatagagaaaccactacagaaatatggaagaggaagaggtgaatcgatgccagattcaggaatggtatccaaagttcaaatctgtatccatcaagaccttaattcatcaacttcctgaatcatttattcagtaccttcttgatgactcagggcccttcctgttgcctgattctgtcttaaatgaagatgcattacccaatagaattcataacccggatgaggaagaagattttcaggtgtctgagggatctgatgatgaagcagaagcttctccaccaccttcttttccagaacttgaattgaaaattaaggactccattgagtcccttgggggtgcagtcttccctaagctgaattggagtgccccaaaagattcagcttggataagcacctctggtacccttcgatgcatcagtttcagtgagattgctcttttatttcgagcatctgactcattggtccacgatttgtgccatgcttatgattcatgccagaataaatcttcaactagaccccagaatttctttcttgctctccgtaaatggtatccatcccttcagccagacatggaatttcgatgttttgtacagaaccagaaattaattggaatttctcaacgggaggttactactttttatcctgttttgcttgaaaagaagaatgatctccttttactgatacaggcatttttcatcaatcatgtgagggctaaatttgagtcagaaaactacacatttgatgtttacattacaaatgatgacagagttaagattgtggatttcaacccttggggtgcatttacattgtcattgttgtttacatgggatgaattggaccatattcatagtgaaggaaatgatgtggagtttagaattgtggaagatcgttgtgctgttaggccaggccttaaaacagcagtcccatttgattacttggataccagcccggggagcggttgggatcaatttctaagaaatgcagatgaagagttaagacgacaatctacaggagctggtgcatgataaaagtttttttttttttttttttaaatttcattttgagagttttgacaaagaaggtgaagacacatctttgaaaacattaccccgtagaggatgcagttttccttttagtcttagtctttatggtttataagttttttatattggactcctagttgccattgtaagttgtatccaaatatcagggctcagataatttaatgctgaaacttcagaggcacatggagagctgaggtggcaattgtctatgatgaaaccaaattatcttcccttttaaattttcatatggagaaaatatatcatgtattggttttttgtattattcatgtgcctacttttgtatgtttctttcactgcaaacacttcctaatgcgtctttgttgcatctctttggcaaactcggtacataattctttttgggatcgtacatgcatagttgatcatttcaagtacataactcatttatcattctatattaataatctatacatgatcatttaataattttgttcatgtgctttgtgtttcgtaaacactctattgcttcatttatttttggatggtttgggtgagagatttgtgtgtgtgggctggggtgagtgaaagagggaagaactaggagttgcatgtgtttgtttgtataaaagtgacaagtaaatggtgatggatctcacagaaaatgctcccctctccataaatgagactgcacattatagaagttaggaattagcaagctatcgaaaatatctttatttttttttcttatttcatattatttaggaaaaattttagtaaatttatcttttaataaacattatgttttcttttttttcctacccttcttctcttgtctggatcacatgagtggataaaatttttactatatcttttcattcttatatctctatctaaataatacatatttttatctcatctatcttctttccctccctcctctatcatctatttctttcttatttcttttttatccaaacacataataaaggaaggtatttaagactctaaatataaactttgaaaaaaaaattagagagatttttgagttgcaatggtgttcaggggactagtttcatgtaatttgtgggaatatcttagtttcttctttttttttccttgatgtacatcaagggtaggataatactaaattaataaccaagatgaaatgtcaattttaatcaaagaacaacattaataatatctataatagtacatctaaagtgtatccttaattaatagtgataaaaaaggtatgaagatattacttgtaacatgatttacagtccaaatcccaaatggaccaaatcaataaataattttcacgaggcaaaaatcgaatttgtgattcctcaatgatttttttaaaaaagcgaagtaacgaagtaaatgaattaggaaccagtaattgaaaaagtcaaaacaagaagatactaacatccatataaacaggccaaacactattgttttgtattttttactaaactgacataatcacacacgaactatgattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaaatatgaaacttcattgtttttcagcgtgcaaatttagatgctgactaagaaaaacaaaggctcccttcgctagcgaattaagatcacacatttgaaccattggcttttagactttgacagtatctgaatgatctaattgttatgttcaaatactgtaattttagctccacttcctaaaacacttgccagtcgttccaactcaaattaccatcctcaaatacacataaaatttaaattcatatttgtccaactagtagcaaagaaaacaattggaatggaactccacaaacagaattccaaatgaattccaatataatcaatagaagttgtccatactagaataagagaaatggtgaaatatagataactatggttatcattccatgagaaaacagcagaaaccataacatgagaaaattataaacattaattcataaaaatattaacaataagcaagtacaaagtccaattcactgatagtagattgcttagtatgctcatccgtttctagcaccaagcacatgcacctgaattgttcttatttttcgatcttcttctgatataatttcacagatgcatgcatcatttttatttatcttgttctttttacaaaaacttgtccaccctttgatgcatactcgaccatcatgccactcagacacttttgctaattcagaatatacgggtgtccattgtggcaagccatgatagtctcgtaattcatctctttgagtatcctgtagcaacaaaaaaggcacagaactgtaatttcaaattctcaatacatacaaatgtacctgacatatagttgacaaaatggtaagtaacttctaaaattatacctcgcattggaagcattggcaacgtgaaagggtaatctgttctccaaaagtaagggacgagtccttaatcacattttttggaacatgctgaaataaggaggaatgaagtgaaaagtaagaacatgtaatagttgagttatgaaaagtgaaattgcaataacgaggcttaaagagtgacagaaaatgaagaaacactcaattaacatcttaatttcaacatggacataataatatagaaagattaaaagtgtttacagtccaaaggaatttaacttcaaggagggaacaaaggcttaagcaagtttagttactcgtctaacacagtgctccagggacaatatatataaagattctaaccaattcgttgggtctatttttgaagagctttgcttcaaaatttggatttcccggctgaatatacatttgtggatcaaatccatagttttcaagatgaggaccttcaaccacaggactggaacttgttgcacttaaccctaaaccagataaatcaatcatcaggtaaaagctgattcgcgcactcataaaatacagaaattggaccaaaaaaacaaaaacaaaacccagtttttatcacaaagttaacttttggaagctctacgaggatgagtttgactcctcgtgtattcagcactatgttcttcttcactctcttcttccatttctctatactgatcaccatcatcctcatcatcctcagcttcttcatgttcttcatcatctgtaatctctatcacctcatcctcttcttcagcttctgtcctttcacaccgtgatgattgttcaagaattacaaccttgaaaatgttggccccatcatacttaaaaacaatataatcttcttttcctaaaaagttttcttcttgaaaaatcttccaaccctcttcaaagtaaattttgtttccaaaatgacgtgttttcacattccaaactctcctaccaacatttgtgaggatgacatcctcagggatcctccatccttgtaagcgtgtagatttcacaaaagcatctgggataagctgaaatttatagaaaagcagaaatgttacttaagatctcgtaaaaaaaaatgtggtatatatggcacacacattatgttatcaatataattatatgtaatgatctatatcttgtattacaatattccaagtagaaatttgaagacattaatgttatatcttcgtgtaagtctaggtttgaagtatattaaacaaaataccatgctttcggagtgttcctccggtttgaagactgtaacgaagtactttttggcagccatccaaagaaatttacacctctcttgtgatattccaacaaatgaaatttggtcaagaaattgaaatgccagaacacacagatttatgacatatatatatatatatatatatatatatagcctgaggggtacctagcaaatagtacttccgtataagcactctagtgagtaaggataataatgcattgactgcatgagaacattctattaatatttatttatttttactgtttttaaaatttttgtccatacgaaagaatgctgatccaataaaataattaatatataatctattatcatggataaatattaaagcaatttaattatttattcatttttaaattaatacaaaaagtaaagaaaaaagagagccaccaatatgattagatccacatgtcaatcaatgacaaagaatcagagaaagaaaagaaaaaaagatgataagagttttaaatgatcttattaatatcaatgtaattaactcagataactctttaaagtcttctctcacttttgtctctcattttttttcctgttttttctctctcacatggaaccgtctaaaagcccatacctaaagacctgataaaaaatgtctacactttaaagcctaaaaccaactcaaataattagttgccttcctctaaaaagctcaattaatagccaaaatatcacattctatgattctaccgtgtgttcagtactgttcctttgtctttactcggagataatctttgtggtccttcgcaggtgatgttattacaaaatatgctatttcagaaaagcttaaacaaaagcaactttcagttgctatttttataaataacctacaaactaggttgcttaattaggtctggtaataaaatttcagtttcaagataacactgaaatttgcagcttgcgggctttaaagtatacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatgagactcacaaaaaatttaatttttttctttccttattatttaatctcaaaaaacgacctctaaatgtcttcccctttaataatatgtgtcaacctcgagaataacaactcacccctggcatgttttctacaggattgcatttttgtactataagtcatcatatatataaacataacttattatacaaacaaacataataacctactcaaagataaataataaaagaacactggccaattttttatataaaagaatgcttttaggtcttaagaattaatgttatataataattattataaaagccatacataccataatttttttattgattaacagtgtaatttttttcactcttacaatgtatgaaaattaaattcattgacatataatattttgtaaaaattcttcattttaaaaatatttttaaattccaataaatttaccttttatcattttaaatttttaatatctgcatttttttgagaaaaataatgtatacataaattaatgaaattaaataaacatgatttatacgagtagtcaaattaaaaatattttcaaattagcctatttaagaaatgttttgataaaattagctaacttgtaagcttggtcagcttgggctaattttctttagatgtttaatgggacaaaacttaagacgccttgtaatatagtaactttttccattaatttttgtagcatgtaagaagaaatataagtttgctggttaagagctgcatatgttattgggaaatgggagctataagatggttaaaaagtatgttgtcgaagaaaacgatggttaacaactaacaagtacataggaagacaataatctgttgaattcgggaaaagtttatatacatttttttaatcttctagttcgttagaaaaaagacattttaactaatgcagagttcgataaaaaaaaaattggtctataatccattataaggtgcactgagttatggaaagagaaaatagaaaggtaaaaaataaaaggtaataatttaataattgatgcaatagaaaaaataaaaaataaataaaaaagtgaaaaataggccagagttggtgtatgtatgcagagttggtgattgccttgtttttctttgggtttcaagaccttgaccatttaattctgagaattgaaaaaaattgtcatcagcctgagagttgagttgataataagtggcaatacagaaaaaggaaaaacattaaagtgcggtaaaattacctttctattttccattttaagaggacaatagcttcctgcaactcaaatttgcttcctgcaactcaaatctggaatgtaatttatattccctgttaatcatttgtgaatgtaaaaaatttacattctagaaagtctaatccaaaatttttagattagacttttcaaaagattaaaaagatgcagaaaataatcatggtggtgcaagaagtaattaccagacaagaaagtccattgtaggcttgtaggccattcttcaaagggatttgaatcttgcactcacatatatgtatcctacacctttcatttttagttgaaaataccaaactacccttcctcgtgcgaactactcctgcgatgacacctctttcaatcgcgattacaacttcttctcccatgacttcaccttcttcagggcagcttccgacctcctcctcacaagtcacgatgttgaagaacctcctcccccctcctccttcctttgcgcgtctccattgaaggtaagaatgcaatccaaaacatgatgtttttgtcacgacaaatttgaaatgttttttatttttaaccattatttcggagacatgattctaaaagctatataatagccttatggaatgaccattccgaaacatagattgagttccagaatacataaaatgtttttttgtttttgttttcaaccattattttttattgttatggaatagacattccagaagctatttctcactattatggaacacctattttgaaaggagagttattttttactgttatgaaacacatattctggaaactattttttattgttatggaacacgtattctgaaaggcggaaattattttttaatgttatagaacacctattttggaagctattttttatgttatggaacaactattccgaaagccaaaagctatttttatactgttatgaaacaactattctggaagctatttattattgttaagaaactcctattctaaaagacgaaagttattttctattgttatggaacacctattctaaaagataaaactatattttattattatggaatatttatttcgaaaaataaaactattttttactattatgtaacacctattttgaaaaggtataatatgaaaatgataatttaaatttttaaaaaaattggaaggtacatgatttagtatgaaaggtgcatgattcaaatcccttcatcaaagcctatagtttggtaactaagctgctagcctattaccatcacaacatgccacaatacacactaaagcccaaacctaaagacccaagatcaacaatatctacactttaaagcctaaaacaaactcaaattagttttcttccttcaaaaaaagctgaattgcaaaggagaaaggtccacacaaatatcaaattctacaatgtaaatgttcctttgcctgtactaggaaatcatctttgtggtcccttatactagtaatgttattacaaaatatgctatttcaaaaaagtttaaacaacaagtaactctgaatagtttttttttttttttcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaaagagaaacaaatttatatgaaaatgagtataagggatatccaaacccttttacgaaataaatagctaagtaactaccctccaatatcctccttcctaatagtggttattttgtatttacatatgtccttggaaataaaaataaaataatcacagtaaaaggattgttattcatcctacaagaaaccagcaaacttatacgatttgattctatagcggtttcaagcattataaatgtcttccgcttaatatcatgtgtcaactgcaacaataacaacttcacccctcacccgtggcatgttttctacacgggattgcattttttgtattaaaagtcatatatataaacttaactgataaaaaaactattataaaacatgtttaaataattgtaaatgatataatacatttatgactatgaatataaagctattttaatatattttaatattcacaattatttttacacataatatatatatattaaaaaataaaaaataaattaaaattataataatataaaaacttacatactataaattaacattcgtgcataatataacgtgagttattacactagttagaataaaatttatttggtttctaataaacaatcaatgataataagagtacaacttatatcatatgataataggttttacataaatttcaccttataaaaaaacattcgttcatgaggtatgataaaactagactaagcttcttaagtgagaatgtatataaaaaaataaataaataaataaaaagtaattgcacattgtttcaatagaaataattataaagacccaaagaccatacgatatgttttgtcttttagtaatatataaagatgacatcttactttcttctctctctctctctctctctcttttgaagtttctatgtctttctctcttcgtcttcttcactcgttcccgatgtgacctagctctgctagggtttattgctttcaattaatatcttgagctctatctgttgaacaatgtagatgatagtagtgtaggtctttttcttgttcttgtttatcttgcattgcaggtgaaggttctctcatgtctggttcaaggaatcggaggagaggaatccaatgaaggttaagtgttgtctggcccaaacaatggtgtaactttgagttgaacactattgtaactcttcttgggatttagtgcaagtaaagggactacagctcccttgcccccttagatgtaggtaacaaggatttttcttcctagtaactaaaccaagtaaatgctcgtgtttcttttcttttattatgcttccgctaatttcattttaagattgtgcacgtaatctctaacacacataaatctatttcaaatcaagaacgaatacaccttttatacaatgcatcaacatcatgttatacgaaaggtaaatatagaaactgcttctcaatgcttctaggttttatttgtcttttaaggcatatttataggttttatgtcttaaaaggcttcataatagttaagcatctaattttattttgtcttaaattaaaaattatgtgttttccctaactagtagtcagggactaattttgctcgtggtacataactattgttggtccaataaaattttacatacatgaagaatcaaatacaattcttttactaattagatcatcattttctcatatgttaacacatcaagaccttatatatcattatgccaattctatgtgttattagttattatgcgtttgattgtgtgtacatcatcaaaaatactaagtaccgaaaataaaggatttaggaaccagtaaatggaaaagtcaaaacaaaaagctattaacatttattagaaaacccaacactattacttgcattgtattcttctagaaaagaattacttgcattgtattaccaaactaacataatcacaaacaaactaaggttggttgaaaaacaaatattaaacttatcgtttatttggtgtgcaaatttagatactggccaataaaactgaaggctcccttttgccagctaattaagttcaccgtttgagctattggctttcaaactttgacaatatttgaatgaccaaattgttattatgttcaaatactgtaattatagttcactttctgaaacacttgcaactcgttccaacatcaaattggttcaccaaactcatgcgcataaaactttaaatttgtatttgtccaattagcagcaaagcaaacaagtggaatttaaccccatcctcgttgagcatgcaaaggtaagtttagctgtggtttttttttttttttttacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacgaaagtttaacttcatgttaaaaactggtttttgattttccaaattctgtttttatgagtgctgaatcaggctttgtctgatgatttatttatctgccttgggggagaatgcaacaagttccacttccacccatgattgaaggtagtcttgaagagactagaaatttgatccacaaatatattcagcaaggaaaatccatattttgaagcaaaactcataaaaaatagacccaacgaattgtttagaatcatatttcttctagtcctatctcttctaatttgctgagaagagacataaagattctaaccaatttgttggatatattttttaggagctttggtttaaaatatggatttacctaaatatacatttgtgatcaaattcatagtcttcaagacgaagaccttcaatcatgggtcaaaagaacttgttgcattctcccataaaccagataaataaatcatcaggcaaaggctgattcagcactcataaatacataaatttgaaaatcaaaaaccagttttcacataaagttaaactttgataaaaaaaaaataacataaagttaaacttacttttgcaagctctccgatgatgagtttgactactcgtgtattcagcactattttcttcttgactctcttcttccatgtctctatactcatgatcatggtcatcataatcctcattctcatcctcatcctcatcctcgtcctcgtcctcagttgcttcatgttcttcctcatcttcagcttctctcctttcacacagtcatcattgttcaagaattacaaccttgaacacattgatcccatcgtgcttaaaaagtagaaaatctgtttttcctgaacagttttctttttgaaaaacctgccaaccctcttcaaagtaaattctgttccaacaagaagtgttttgacattccaaatactcccactaacttttccgaggatggtgtgtagacttcacaaaagcatttcggataagatgcaatttgagaaaaaggagaagatgagtgttactttagacactataatactctggtaatgttttgaaatcaacaaatacattggtataaagcaatgtaggctacatagttaaatctcagtaaatttatgatccatacaatgtaccacaatattttaagttgaaatctgaggacatcaatgttaaatcttcatataagcctacactgcagaaagtataataataaaaaaaaagaccttgctcatttaatccaatgaaaattgaaaaaaaaaattgtcaccaacctgagagttgataataagtggccaataccagaaaatactaaaaggaaaaacactataaggtgccaacatgaaagtccattgcaggcttgtagcccagagtttagtccattaacatcacaacatgccacaatacacagttaaggcccaaagggaaattaacatcattatgatccttatagcttattgaacaattctattatattgttgttataaaagacttttttttttaatgaatactcaatcacagatcgggttaagaataaaattaagtataggaattaagaaacgttccttcattaattctcattttatgtgtcacttttaaaatatttctgtattaattgtcattttaaaacataaaaaagtatcaagtacgtttttcaatatatttatgggataaacgtattttgattaaataagattttaacatatgagaatagatcacatcaaattttaacatgtgagatcccattttcatctgttattagatttaaccaacaagcatctaattccttccacttctcccttctgcaatctatacctcgtaattttaatggcatcagcaaaaattctcacctaacagcaccagacaaaaaacaaatccacatatacatccatcattttcttttattttgtctcttttacttatgcaaaagcatgcccactatttaatacatacatcaccatcttcccacttgcacactctcctgttacttacaattttttttcatgtctcttgaagaaggaacatgtaatagttgttagtaatgaaaagtgaaattgcaacaatgaggcttaaagagggacagaaaatgaagaccactgaattaacattttcaacgtacatgaacaaaattatatacagaaattaaaatttaaaagagcttgccacttacacattcccaagtgttttttgcatgtgagttgtggcaagcagagaagaaagtctcatcattgatatagcaattaatagggaggaatgaagccataagtgaaaagtagagtagatggaagaaggaacattgtgcagtgtacttggtgttggtgtgagttatgaaaagtgcaattgaaacagcgaggtgttaccacttaccaggcactgtttttttcttctgcagttgcttttctcttctatattccgctctttctctaactttaccacaattcttccatacatgttgataattgaaaggtgatgatttttaagtcattctctccttatactgaaaaattaaacagtcttttctatatgctgtttttaaaaaaatgattttctagtttttatatataatgaaacaataagttcaaaataataatccttcagccatcaacagtgtatgaaaagaatgtgataaagttgcagaggaggaaaatatagaacagaaagcaggtatagaagaagaggagattgagattgcaaaggaagaggaagacactgaagatgaggaaatatgatgatcactgattctgaagacaacaacgatgagtatacatgatccaatatatatagcgtgagggttatttaattttgttggttttaattatgacagataatgaataatataaagagtgtgatggaaaagaataactaactactgaaaatataacttattattaaaattttgccttttaatatattattcataacaaattcaacaatctcctaaaatcaagtaaaacagactttgacttatttaaaataaaataaatagataattttaatcagttctaaaagtaactggtaacaaatttgtttatttttgtttataaaagataaaaaaaacagaatttacaacaactcaattcctatcttggtcaacaaccagcgttagactcgtttgacatgagctatctaattagagatctaatatatatacacatttaatatacttgtataattaaatgagtaagggctgtgcattttatttttacagtttacatctctaattaaatcagtaatgaccctgcattttgtttttactgttttaatttttatccatatgaaagaatgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttttattattttcttgtattttaaaattataattctcactcttttaacaattttaattcttctcttacttttaacagtcttttttctctcacttccaagactaatgtagacgaaaacactcctctaaagtctaaaaccaaaacataaatgcccgataaaaataaaaataaaaaattaaacatctttgcgagtttatgacataagaagatggttcatatgcattgtgcagtgcactaatagtttcagatgaaggcgttattatcacctgataaccatgatagctagttagttgactataacagttacttagtttagttaactttgcttatctggcaatacttatctgaatacttttgtatatgagacacaatacaatatctacatagccatgtatgaattgaatcattctttctataagaaaataatgagaactccattttctctcggtttctatcaccgacagttatgatgcaaatgctgccttcaatttttatttgtggtccctcactaatttctgaaaatgtttaatcaccccaagcaactttcagcacctagcttttctatttttatgaataatctatggcctatagtatatatgactgtgactatgaaccaggttgcctaagttaggtctgatgaaataattgcaatttcatgatgacaccgaaaacttcttcaacaggcttgtatggttagattcccatccgtattaagtattaattaatggacaatggcttatactttataagagagaaaatagataacagccatagtcattaacatagtcatcataaaatttaacgtaacattacttactctagcaatacttttagtattgaaataatttttttgtcaagttcttaaatttacatgtcattctcagcctcacaaatttaaaataaataatctatttaaacaattatacattataaatgtcgtatataagtgtttacaaatattgataccaattttattttgtcaataatgtgcatgtttgattaaacatttgaatctctaagaatatgtttacccacaaatccaaaggatatttttctccattcgtttgttagatgtctatgggaatgcatgtcactgcatcttcatcagaaatccaaacataaacaatatatgggatttatttttttgttgaaaataataatatctgtaattaatatattgatattccctccatttctttcgattgtccccttaaaaagttaatacaaagattaaaaaaagtaattaatatttttttttgtaaaaatatttttaactttagaatataattttactgttattttctctcatttatcataaatgtatatagtatttaagacctaaatgaatagaaggacataattaaaaaatggattgataaaaataatcaacaggattatnnnnnnnnnngataaaaaaaaaatatttaagcaaacattaatatataccaaataattaattaatgggaagcacttaaatacaatattagagacattattagtataattttccagtcaaaatcagcaatttaccatgacaatcactcctttcatttcctttacaatcgatagtaactattaaaatgatgtgccaattttgatcacagaacaaggttaataatctccaaaataacttatttaatttttgtccttaactaatattgataaagaaaaaggtgatctcagtaatgaagacgttacttgaaacatgatttactgtccaattgcaaaatcaacaaataattttcaaaaggcaagtaccggattttgtcttgcgccttttgaatttaattatatttcaatatctccctaccttgctatggacatgagtggagaacatttttggaggaacttaattgatatgcgcaaagtacgttattgccttgttttcttttggtttcaagacctggtaattttattcattgaaaattgaaacatactttttctttcccaccaatatcgaaacttgaaacatactcttttttttcaccaaaatttgaaacaaatatagaaatttcaagacctgagggttgatatggtcagagacagaaagacgtggcttgaaacatgaaagtctaattgtaggcttgaagcctattattcaaagcctagtcggagatgcatttgaccaggaaatatcgtactagccattaccttcacaagtcacaacattttctttctcacaacattctgtatctctgtgtgcatcaaatgcatccaatagctctaagaacaaatattattgttgttacaaaaacattttcatgaattttcaatcatagatctagttgaataaatttaagtaaaagatctagttgaataaaatctgctactcaattattctgcacttgaaaggcttcataataattacttaattaggggtatggtttcgtgtacaaaaaaagaaaagacgaagtaataaagaaaagaaactaggaaccaataatctaataagtcacaaacactcttacttcgtagactctattaccaaactgataatcacaaactaagattatgcaatatgcttctttattgtgaaggaagtcgaccgataaaatgatttctgagtagctgcaacttgaaaaacctcaaaactttctgcatcatatacgttaactatcttatcttatctgaccataagcaccgaaaaacatctgcagctcttaatcagtcaacttatattccttattacatgttacaaaaaattaatgaaaaaagttatatactccaactccaagccacgggtccctcaactaatttcaacataaaaaattacactaaaaacacttaaattttgtcccattaaacatctaaagaaatctatcccaagctgagtgaccaacccctgaatacacgcaattagtcaacataaagctgttacactcattaaaaaaaataccaaatattctttaacttgatagataataaataaattatacaagaaaacaactcaatacatctgaaaaattccaatccaaaaaattccggaatttcttcctacaaccgacaatctcatctttctggccaaaattcaccaatattacattgaacatcatagaaggcttccagaaacttgaatatgctgaactttttcaatttatgtatactacatttcaaacaaaatagagtacatttcagtttaattgaaaatccagtctcattctctgactctctagtccaattccaactattaaaacgtaccattacgacaatggaataaaaaatgcacatacaaatctaccgaaaatgacgaacaatttcagaagcaaaatcaatgactacgctgctgcattacttgaggtttaatagcacaataatatcttggcgtaaaacaaaaagtagtaacagaactaaaccccatgcaattcgctttggatctaaaaagacaaagaatatcgcaacaatttcaattcaacatattacaactaaaaaggccgaaccaacctgagaagaatccaccgaacagaccggccgtccagatcctgccgtttacacgcgcgcgactgccggcgcggcggcagaagcggcggcggcgccgaggaacgagaggaatccggagctgttaggctcctgatcgtcgagaaacagatcctcgggaacgcggaacgcgccgtgcgcgcacacgatcgccaatccaaccatgagtgcagagatcaacaaggatccaacgctggtgaggaaaatgacgaacacggtgagcacaacgaggatccctagggtttcgcgatcggcgaaggtgcgtccgaagaggatgagaggctgatccgaagggcgaaagaggtaaaggaatgaccacgacgcgaggagaccgaagaggacgagtagcgagaacggatgcgtgatgagcgagaccgcgagcgcaaacgcgattagggttaggtaattgacgcggaagtaggcgaagttcttgcggatccgagagtatgcttcggcgagggtgtcaggtcgggacatggagccccggtcgatgagctccgtccacgggcgacgctgcgccaaggcgtggcggagcgacgaggagatgcgggagatgaaggcgcggaacgccggcgtcgcgatcggaggctgggactgcgaggtgccgccgccggaagcgctggattgggaggatatagggagtgtcggtggagaggccatggtggcgcgtgaatctccaattgccgcgcgtgaaccaatagagagagcgaggggcaatggagactctgtggttgggcctttcgggtttgggaacgaggaagagcacgagggggctgttagtatgtaaatgtaaatgtccgaaaataaccttcctaatgtgagatgggcatgcgtcgaacctatttgcagaaaacgcaacgcaaaaaatacgtaataatgtggacaaaaaataagttttaaaaaaataagaaccaaaataacgtcaatatgtgtaataaggatcataattgaaatttgaaaagaagcaatcagtttttattttaatttaattaaaatacacatattattttttattatcatctaatcataaaaaataattaaataaatattatttttataataattaattaaaagtcatgacaagtataaatattaactatttttttcttacaagtcataattaacacataatattgaaaactataagttactattagtatagttttataatattatattatttatttagtactagggaaattatgtgcacttttaatccttcatttattaatataatatatattaatccctcgtacattaatgttatatacaatgtatttttatacaatcaaatgaacaagtaaaaatttgacaaagtaattttcacgttaaattagattaaataaaaataattacggtttcctatataaatctttcgggaaaaaatgtaaaataagatcatatttttaatttaaaagaaaaaaaaaatattttcttaaactaatgaactccttaacgttctgtttttgtttgtatgtcacctttgtcttttttatatgaaaaatatcaatatttaacagttgtatctatctggctagacgtttgatacttttggtgggcaattgctttctacacctctcttttttttacttcttgtacctccaaaaatgtccaaacaaacaacaatacctcctccacccaacaccaccgtgccccacctccacccaacaaccatccaacaccactgttgatgactctgactctggtgctggtgtggggaaaaagtcatgcatggagtcgaggacacgagagaagtggaagtaaaacgtgataacattttgaaaatgttttttctgaaaatatgaattttttttaaccttttaaaaaattatttttgaaattatgttagcataataatttaaacttttcataattatgctaacaaaatatcgaaaatacatttccaaaatgttattatattttttacataatttcataccaaatacccatgaggctgtaagcccatgaccattttacacacaactcaacaatgtgttgagtagtttgagagattttatataactattgatgaggtgataatttgaataacccttaaaatttaaaattctcaaaattagttaaaatttgagaaaaacttgtggtttgaccattacatcgagtcctttttaagaggaattacatcaagtcttagggggcgtttacttgtagtttttattttctgattccattttttatttttacttcttaattataaattttttatttatttttaatttgtttcttatttttaaatatttatacagaaaacattttttttctctgttcaaatctttaaaacacagaaaatagattaaaaataagataacaattttacaattaagaaataaaagtacaagtaaacgccccagtttttctcacattttttgtatttctataaatatataatttttctgttaaaattatactttttcacatgttatatttgaggattaaattactttcattgttttaaaagcgcttttaaaaaaatgtttaaagaaaaactattctaaacccattcaatatcctttaattgaaaacaaaataatacatgcccgcatttattaaagtcaacatgtcaatgtgcctagatcatgaccaggtatcgtaacaaagtagtacattgtgtatacaacaattattacaccttcctttcctatcaagagttttaaatatttctaaagtgggaatatattcacgtattaggtttattaccgatatgaatatgttgaaactaggtgtggattaggtagcaaccatccaagcagaagtggaagcatttattatgttactttcttgctttcaagagaaacatacttaagtcaacaatatatgctgagcatctgaactttctaacctagcttgcctcatttttttattgaaagtgcctaggccagttatttcagaggttgaagaattaatgcaacttattttgtgtgtaacctttttacataattatttaatgttagtatgttacagacataattgtgtataaccttttgcaattacaacatttgtagggactatggatttattaaaatatttttctaccaccttgtctcaagtaacgggcatatgtcatgttagcacattagatgctctttaagaaataagtcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaattatcacgatcttagtatttgtttgacacatggaattattagacatgaaattaaataagtgtttagactttaaaaagtcttgcaaaatttgaattgcaatattcaatacttaattttataaaattataatacaattgaatacaaggtgccttaatgataacaacaaaaaatttgagaagggataattcttctatagagtgggagtaagggtttcttagtatattagataactgccggacaggggaattatgatgttgttccatagttaaagaagcacactagagatgacttatcgcaactcgagaattttaacaagcatgattactatcactagccgcttccatcattattttactattactggtgtcatttttgtcatttttatttttctcataattaggtttggagtttgaattggatcggttttgaaacaaaaaatcatcttattcaatttctttgatttgatcatttgatcattcattcgatttgaaattttttttaaattcgatccaatccaatgcaatttttttcggtttggattggatcgattttcgatttttaaaaagtctaaaaataacatttatgagacttatttttattaaaataaggagtatctaacataaacaaacacattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtagttccactcgtcaaataataaatgtttgtaaatctatgattggccttccttatttttatttttattttatttttttttaattttctgaaagagaaatttcatatcatccacaattgagaacgaatatttccattactgagacataactttgtgttatttgccaatcggattcaatggctggaccttgtcaagccacataagtaccatagatatgctactctagtatttaatttggacaatcaatgatttctcaggaaggaattggcatcttcaatttatccatgtcgtcagagaaggaaatcagtgtataaatttgactatattaaaagaacacaccttaacaattatacttgcaaaacttgttaaaaataataataataatatattatacataaatgtaaacaactataaatgtatcatgtgggatcggatcatatttcaatctttacatatttagttcctaggcatcttttgctaaaggctaggtagctgtgtactccttgtatccgattgtatttctacgcacttagtctctatgcatctcatgtttgaggtatctcatgtttgaggttaagagactctatatcctcctagatcaatttgtgtccccattcacaatcctccttaaagggtcttagcccaacactatcttattatatcatatcatgcccaattcaatcacctctaagagtaattgcaccataaaatatcatggacacaattatgtacaaaaatcctctagatatcatgaacattctaatacatcataatttctcgatccataaatattggaaaaatatccgtcacacacaagcataaataatcatttctttgatctaagaagacaggttaagtaagacactttatttgagtattttggactaggtcttcttatactaagaatcctttgttgaaataataaatttattcattttttcaatttttttcttaattccataacgaataaaaactaatagagactttacgtacgtaacccatatagttctgaaatcatctatatcaaagaacaaacatatacggaacactttttgttaaaccgattttttaaacaactattattcgtaaattaagagtatatatgatttgaaagagtagctttattcctcacggaccccttgatcatgaaaatggtagcttaattgatattgatatatagcttaaaagttgtatatatgttttgtaaaaatattactcaatattaattagtttgtccaagatatatacttttggtcattgtcatgtacaccccaccttcacccgataaagtcaggcagtagtgtttataaaacaagttgaaacttgaaacaagtttaacacgatcgtatatactcaaaattttgatattttttttatatttaattttaaacttaaattgacataataagaaatgataatatatgagataaaattgagtcaacttaattcattaacataatatataaattttaacattatttattactaaatcataaattaaaaaaatatataactaaattaaagtataatgtatggtatatatttcaaaataaataatattaaaatatattatcattttattaactattttcagaaatcttattaataatacataattattttgaaaaacatgcatatacattttaaaagaatatgaaacactaaattggtttgagatatatattgtttttagataaattgaaattaatataatttaaacttgatttcagaatatgttataagtataatttctaaatcttaaatttgtaaaaattaacttaaagtcggacgaggttagttagtgaagtggaacatatatgcctatccaaataagtaaaataataatagttcttttgtttttattattgcattttgtaatcatgctagaataaccatgcatttttagacaactaacacatgtgatgggaacgatagaacacacaaataatcagtttatcttgtaagtacacactatccatcattgcttttcccaggtgctaatcgttgtactaatcacatgcacaactacttttgacttttcttgcccaacaagaatctttactaatttgctttttcatccgttaaatagagaactcaccaaatatattaagtcccacacgacaacacccatagagttatagctagctaggttaactttctgccatggcttattacagatttcttgatgtgttttcatggattcaaaaccttccaccaatcccagaatggaaaacagcttccatgtccctgagcatatgttccacaaactcatctcagccatcacttaatctcaccatagcaaaaaatcatcaccaatccccaagaatctctttagccattgtggcagacttcaatattcccatctccctttggacctctaaacctttcaaacccagcaccaaaaccatgaggttaacagatgatgaaaccctttccaatctccttgttaatttcatagaagagatccttcattatggctccaacaagcacagtattccctatatcaagttccccaaacttgattctgtttccaacttccaagacattttcaaccttgcttttctcaccctcttgttcctagtttgcatatatgaagccccttctgatcttcgttctggttgccttagcactttgaaagaacaattggcagggtgtcaatcaaggcaagcatcaaaatttctgatgaaactcttgggttccaacttggaagagcagtggatgcgttctgtgaaccttgcaatcacaaattggattgtggagatccaagaagcacatcacagtactgatcacaccaccttcagaacaccatctcctctattttcttatgcgttctcaacgtctgggttgtggaaagttcaattgtactgccctgtcataaacatggatgttgtcaatgcaaacaaccacccagctgatgagaggcttcaattctctctcaagtaccagcagcttgaaggtgttcttcaattcaattacaaagtcataattagagagaggtgggttgaaatcggggtgaacattgacaacataaggtaatcaaattcaaaaaaaaaaaatttattttttgttagttaacctcacaatttaataaattaatattatattttttctaatttaattttgtatcttagaagacacgaaaaattattatataatttgagactatcatgattttgaatttttgacaaatctctatatataccacaaagttaaggattgttaattctttcttataaactaattttgttagttatatgttgtataaagattagttggaattatgagcgtacatgttgattaatttgaatctatctaataattctttaatatcaccggtatctttatgtgtcaactttttttcgcatccttccaattgaaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaaaaaaaaaaattaacaaatctgagaaaaataaaattttccaatcgcatgcatgacattttttctattgaaaagacagaaaaaggagataaaaaattgaaggtgatcatatctatgtatctcaagttcaacacaataaaatcaacaaattcgtgagaaaacgttattttccaatcacgtgtcattttttccgtaaaaagagacaagaaattagaagtgataatttctatttcaaaattgagagaaaaaataattttcaatcacgtgtcatctttctatattggagagagagaaaaaaaagagtgagataagaaatgaggattgatcgattgcatatactttttgaaatttgtacaatacccaactaaaaaatatatgacttgtcatcattttctttctctttatgcatgtgaggtgattttctttcttattctttatcatgttaaattaactaatatttacatttatgtggaaagatgcgatgttttcaaactggtagatgacattctgatgagagaacgaggagcaggtgcagcagaaaaacatttcccttcaagaatctcattgcaactcactcccacaattcaacaacaagtattaaccgtatccgttggcaaatcgtcagagaatccacgaatagagtttggcgtggagaaaggcatagaagcctcattcgagccaccaaatccttacataggacttagcgtatcagcaggagagtccacaactctgagcttaaagccctggaaattcgaacaatcagttcatggctacagtgcaaacttgaactggtttcttcacgatagcaccgatggcaaggaagtgttctccacaaagccttcaaaggttgcgttgtttaacccaaaatcatggttcaaagacaggtatccatacaccgtcactttaatgaaattactaataattaaatagcatgattttttaatgggattttcttgtcgtacaaactcttaatttttatgaaataaattattttttcattgactcaatgagagtcttggatccggcattaggtactcgagtgcttatcgtcctttcacgaggcaaggaggggttatctttgcgcgtgatgagtatggagaaagtgtgtgttggaaagtggacaaaggtgctgtggggaagacaatggagtgggaaataaggggttggatatggctaacgtattggcctaacaagcacaagacgttctaccatgaaaccaggaggttggagttcagggaaacggtctacctcaaaattgcatagcttaggactcacgcaaaggaatatatcaatcaactttgatttggactatagaaacgaatttattatatcacaaatacgcatttttttttcttcattttattgaacatgtggttaattataattgtaaagtaaatgataacggagtgaaattattggtctgttttcatttttcacaaacacgcgatcatttccatgggaatttaattttaatgactgattgtaaaaaatttgtgttatcgtattactactattcaagatgaaaagtcaatttatcctctttaattcagagtcatgtgtccattgcttcttacatgaatgtaatatatttaaagtttttgtgagtgtcgttgttggtgtggtcatttcatttttaatttatttaaatacattgatcattaattcgagcactattagggaaaaatatagaagaaagtatttttcctgactattcttatccaatttgaaaatttaaactgctatcaatgataataattaatgtgatcatgttagaattggaataagttgacttatctaggctatgggttcttttcttgtttcttttcttcccccctcccgaaattaatgatactatttatttggatgcttaaaattagaaatcaaaattataattctgtattagctgaagaagattattatagtaatttttttgagaggaagattattatagtaattgagaaatactgcttagagcttacatgttacaactttgcttttttgaagaagaaaaaaaaatgttattaattcttaatgaatgtgagataacacaagatgtgcctcgtgtcaatcgaagaatcccctatacaattaaaacatctgcatgtgcaatgcattgtgcatccccatcctaccaagcgcaaactaatatcctagctatgtccagccattcgtgacatgtaagtctaggtggaacaaaaaataaaagttaaatcatcttttatatcttttattttttttaaataattttgattatttatccttttgaaataattcaaactatcattccatcaatttaaaattaacactgttaattagtatttagatatttataatttttagtcgtcataaaatatatattatttttttcctcctcttgttcccctttgaaagtgtgactatcacgagcaaaaactcttctccttttacagataaaaacatatttaattctaaaaataaaaatgaaaataataaaaaatactcaaaataaaatagtattataattttaaaatatttttaaaaaaaagttcttgggagttccaagtctaatttaaacagatcactggttgattattataattgggcgcctgttagctggtgtaaaagtagaactagacatgatcacaggagaagaccaagacattgattttctgttgtacttctcacttcctcaaaatcatttatgtactcgtcttataattaaaaaaagaattatgcaaaaaaagttaaaaaattaaatatattatttatttaaggaatcaaattttaaataaataaaagtattttaataattatatttatcaagaatgaaaaaatgtacatactcattcattttcatctccgttctaaaaagtccaatattacttatattcatgctcgtgtcacacgtagtcaatgttatgaaaataggttcgaaccgacagattggaatgggaaccgtgacatcactcgggccggattggttaatgaactggccatacatgtgactcggttttgtctggagaaaattggacgaatttttgaagacccgacaacctgaacgatttttaggacccaaaccgggttagtgccggaaataaaaaggctccaaacggcaaaatggcatcgttttggtgagccctagggtaatttttgagttttcctaaatgaaataagctcttcacttcttctgttcttcatcttcattcgttcacgctcaccgctcaggcgcttacgctcactgcagcagggttgttgcttcacgccatctccgtcgccggcgcagtcacagtttgacgccatcgccatcgcgcgttacaccgtgatcgtactctcctcggtcacgcacacaaggtttcaccgtgcttgtctttgcttttctattctcttttccaaataatttgaattgataatttttattctcttcaccgtgagaaaatgaggggcgcaacaagcaagtaggcacacacacgtaagttaaaatgaggcgtagtaagcacgtaggcgcaacggcaacattgaatttgaaggggaagagatgtttttatatatatagggattatgatttttcttatttgggccggatttgcttcttgcactccctttattgcttattgtactccttctgactcattttttattaaaatctgtatttgtgttttaatttaattagttgttatttacacttttttattaatacattttatttgttttatcaactttaatacttatatataatataattttaaattttttaatatttatagaatcaaattaaatcaattactaatctaccagttgaaccgttgacccaccgatctaatacttctgactaggttaataaacatgtcggttttatagcactggttgcaattattactgctcactgccttgagtcaaagcaatattataaatatttaacttactatggcaggcacttttaatgattggcaagtttacatttattgcgctgctactctaatgtttgggaacatgcataggcttagctgtgattaattccttactgtatttgctgttcactatttacagaagctgttggttacagagaccctcttattgctgtcttaccgtcattcagaatagcaattagcaagtgacctagcccatcttattgttgatgattagttatgcagcattaatttgttagggagctgagatgcaaattaaatttatagtcaagttattctttctattctatagcaaaataacttgtagttataccagcgaaagtttttagcgatctattcagaaataattatttgtgcttatatattgggcaaaggggtccttttcttgaagatcacatttggtatacagtttactacttgcataaaggcaatttcaaaagtacaaatttgtgttgttaaaacaatggcgatatttaaataaaaactgaaacaatatgctgattattctcactttactttttgctagcatttatggaaaaggaaattatgttgctttcgcaaaaatgtagactgcggaccgaatgatattggagtgtatactagagctaatatacacacccacaccagacctatcatgcatccaattcatcatgtcctgtctttagtttttactggtaatttaagattgaatttggtttgagtgtttttttttaaataatttttatttctaaacttttaagatttaaaaaatgtatcgaaaaaaattactctaaggtgtcattacatttttacattttcagaaaattgagaatattgatttattgttttttagatttgggcctgttttcgaaaatatttttagagaaaatattttcaaaattttaaataaaaatatgtttgctcttattttctattttttttaaatgaaagcataaaacactcaaaccctacctaaatagatataattacttgtgggatcaatccttcactttctgccaagaaatatccatgttcatccaaaccaaaaactgaattcatcgtgactaacactccgaattcataaatgcagtgaaaagatttgtgaaaaataatgataattttatttcgatttaatgcttttccaagggaagctgccttcatatccaagagaaggaaacaaatgaacttaaaaggcagagagagaactggccttgcctctcgagaaattattggagagaaaatatctagggacacgacattatcttatttccccgagcttaaacggatcttaaagatccttttaacatgctccatagcctatccaggccttcatctttcgtttttactcaacagcaaaacttaaagcactaaattaatacgcttttttcttgccatatcatatcataatgttgttggtttggatagtatggaacttgaattcctcaagtaaggtagtgaaaaggttctctgacgaagattagttatcgacaaagctaatggatacttcgctttaatgtcatagtgacaattttttgttatatatatatatatatatatatatatatattatgttaataatgtctaacctattgaacaagctgtaaactatttgaagcatctaacagcagatttactgttgtagaggaggaggagacattacatagttatagagattcatggaaatcaatcttctcaattagattttcacatgattttattatgtgaaaaatttgtgtctgtacttagaggattaaaatataatgaaacttgggaagaatgttgccactgttggtaagtcatttgagattatacattaataaaaaaaccattgtcaacaagaggattatacatcaacagtcagtcttttctagacccagctcctcactcttcctttgaaccagcatttctttgactttgtgcaaggcattttcaagattctccaactgcatatttggcacaattcaattagtctatctacatttacttgttttactttccaatattttcaaatttaatagagtgaatgcctatattttcctagtacaagtagacagtaatggatactatattttgggaaatagccatctggatggcagttccatacctcttgaacagaaaacctattatgtaagaataatccactgtacaagtcaaaactgtctctgatggtggtgtccttctgcaacaagttgtaaagaaccacattgataccatgcctagttgcaaaccaaaatatgaaaggaaaggttttggagggggaacggggaaagtttgaaaacaaaatgattggagatatataccaattgaataagtgtatgaaagccttttgtatcaataggtgtggacttgatatccatttctgccaatgtcctgattaaaaaaaaaaggccaaagttgtacctagtgagcatgcatatcagtatatgtgtttgtacatggttgatggaaagtccacaagttataaagtgcagaaggtagcatatatacctgcctatagtgtgtgtaataaattgactcttggcagctattttatcatgttcctcacaagacatttgtagcatcctgcagccctgttaagaaaagcagggtgaaatggataataaatcaccttggataaatgtgaggtagtctcaataaattctttcatgcttttttggaatccaagcagtagtattccaagaggcagttaagaacttgctgtgggcgagagttctaagattgatttgtaaaaatatcttggcgaagcctctatatacatccatgcctatgctacttgtgcgatgttcctattaatttttctgagttgtgattttttttttctgcactaaaagattttagaatataactaatcttaaggtgatattgtccaaagctaattcaaagctttaacttgatgttttattagttcattcttcattggccgcactatttatttgcaaggttttgttattgatggcaattgactaaggcaattaacgtacctcacttgcaaaaatgtggaggaagttagagcagatagcttcatctcggattcgaactttatcatatacgaatgttagatctttccacccatccttcccactatctggtccaaacattgggtgtgtgcacagtatgtctgactcctctggcaatacctgttatgaaagatgaaagcaatttccttgaaacatgaattgaaaattacaatggagaattctatgtgatgccttattctgtgtaaaactggtttgacaaatttgttacattttaatgataactagctgcccatgattataaaacaccaaatttgtccattcattattgattttggtctgcttggagaagagaaacatagcttattcatacaatatttcagttattatagagtttgacaaaaatccagttattatagtttgtaatgggtaaagctatcgcaatttgaagggaggagaaacatagcttgtttattcaaatattcatcccaagcaaatccttccatcacggattattaagaaatagaccttccctaatatcgcctaaaagacaagtccaacaaaacttgaatcacccttagattatttcccctcccatataatttcaccaccaattcatttttataaaaattaaataccatgaatactagtattctcacacatttcttccttcatacaataattcattctcaccaaggctatcaaacaaaactagagggatcatcaaaatgaagctattaaaaaattgaagtaccttaagtagaagatttcttgggtgctctttaactgaaaggacatcaacaaagagtgttggtcttctgagacaagtgagtggcatagagctgagaacctcggagagagataggatggacgtacatatgagtatgacatcgttgtcagcctcaaggaatgcagcaacatccctgcagggacacatgacattatgcaacatgaagattgccacttattatgtacatatattcaagcaattcaatgatgatttatgtatgtacctgaagaattggatacccattgggaggcataagaaggagtagtcagtacgcgaagttgcccttagagtgtggccttgtttgatcatagtctttgccagaaattgcccgaaggaaccaaacccaactatgccaattttcagagaccatgttgacatgattgggttctaatgttctatggttgctgttgttttagtatatggtctattctgaaaaaagcatcagatcggatcgaggtctaacttttatacttaggtccaactttaattccatcaaaatctccttgcatttattcggacaagattgttttaagataatattgtaaattaaacatttaaaaaaaagaaattcataatattgtaaattaaacatttaaaaaaaaaattcataactactgaaaatttaagataatgctagatataagatgaaatctttacgaatgctcagaaaaatatctatatgatttagtatttgatatgataccgtctggtagtacattcattttaaaaaagaagttgaaataattttattgaataatattttggttttaattccagaaaccgttagtcaccacgagacaagaaaatgcatgaaataaacgagcaataatatttcagaatcaccacagtcgtaccattaacccccaccaaaaaaaaaagattcataaatttatctcatttatatgattttagagataattgctttcatttaaatgaaaacttagactctctttttttataatattttctcatgtttttagtatttttctgccaagaggaaagttaaaaacatattaaaaatttagtgaagaaaataggtctaagaaaaaggaggcccttatattttggaattcttccattttaaggctatgtcttgaagcaaggcgtgtcatgtgtgtaaactctagattgcaaagtaagatggaagtatatttttgtacaacttggactataccagttaggtgaattagccattcctattctagactcatcagtcattacctcgggccaaaactgcaaaaaatcttaaaattatgaaaataataataattcttattgcttcggaaaagttatcaatgtgaaaatttatcagcatataattataggaacctagaatatagaacctaaaatttttcttgtaaaaatagaggaggcaaaacactaaaaacaaaactttatatttttaattttatcaacatcatgaggtgtacaccctaagtatatatcaaagttccccgcaaatcagaaaaaaataaaataaaaaactaaaagttccccaggacctccactccactatacaagcatgtatagtatttatatttatattgattacttctaggtctgattctttgaattttaaaataatttataacaattaaaattaatgaagtgcattgaatctgcattggaagatttccttttgtttgatttatgctaaatgagtatatttaaaaataatattgttttctaataaatatcatctttccaaatgttatttttaaataaattaaaaaaaacgattgttaatcaatgtgtttaaaaaattattttgaataacatgacactgtttattatgaaattaacaacacaacaaacaaaatataaccttttttataaattaaattactcccttaaaaaaagttttttacaacttctaccaaacgcatgcacgttcaatttcattttcttcaaataaccgtacactttaaagaaatcaatacacctaaataattaaggatttgacttcttaaagagatttgtttttgaaagaattctaataagaactataattattaattaaaaagtttaacaattaatattataattaaaaataactatatagttatttaaaaagcaaccgtaaataaagtaaatccctctccggcctaaatcgtataattaattattatgccttggtggtggttataagtttttggcttttaattttttaatgtatttttcaaaataaaatacattcagtaaaaatgaaattagattgattttaaactcaattttaaaataatttatatttattatcaaaatataaaaaaaaagttttgtgaatttgatcatgttaccttaccaccatcaccatgttcataatctttaaaattggtgattgaatcaatcaagaccttggatcactaggtgaatgatccaattggtaaatcattaattgattcacatgacttgttttttattaaaaaattatactcaactttaattgacttgcataatcagcatatttcctcccttggacacgactcaccttaaattagtgggtcatcaaattaatcacaaatttgatcaggttgtatcagttcaatgcatgattgattcgataaacaacttgatccgatcgaatctctagactgtaatcaaactgatctgatcatgggattgatctaaatgttaaaacataattattattattttatcgttattattatcatcatctgtcattattttataatataacaagataagatcgtaaaataattaactcatttatttatttttaatttgtaatatttaaaaaaattaaaaacaaaaaataaacaaaaacttaaaagtaaaactgatcttaattttttttttttttaaaaaaggaaaaatcaccccgaaacggatctctctctgtctctctctctctctctctatatatatattatagtagtttaggacagggtcaccgaccagcagatgatgagaacgagacaaaaaaatgacgtgtaaccttgtcaacaatgaagtgatggaattgtggtaaagtctagccttctcggcccatacccaatagctgaatctgaaataaccgtgtccagggttatggttatctatctatctataccacacgcatgtcacgtgcgtaatgtagttgaaataatcgacccaacccaagtcttctatagttctatgtcctcttataaatacccacccaacacggagtggataagcactaacattattcctcatccttatcctctttgcttcaatggaactcatttccgcttccagtttgaatcccaacgctccgatcttcgtgccgctcccctatcgaacggtggaggatttctccgaccaatggtgggacctcgttcactcctccccctggttccgcgactactggctccgcgagtgcttccaagatccccagtaccaatacgacgacgttttcgacttcgactttgacctagatctccgtaactaacttacttatctccattttacttctctcatattcatatacttttctttttaatttattttattcggatggatgcagaagatgaagaagaaaatgaagggaaggaagggaaagaggtggtgtcgctgggggtcctcaaatggcgaagctgtggaggaggatgggccgaagcgccgaggtatgtggaaaaggtccctaagtttgtgaagcccaaggtgagcccacgggctattcaccagcccaggtagacgccacccggcccattcccccgccaccaccagctatgtacataaaaagaaaaagtgtcaagcgccatgacttcgtcatcagagctttctttacattttctagattttaattttcgtgttgatcttcttgttacttgatgatgttccataaagttaaactcaagtttctttgataatgacgattgctcagcttgtgtccgtgttacagatcttaatatctgcgaggctataagttctaaattttattttgccaaattttaatatcgagataacgaagtcgtagtatgatttatgggcgtggcaaaataattcgattattttcaacgcttcaaaaattttattttccttaatgagatgagtttactttttacacgttacaataaaacgaaaggaacttactatcagcctattccttgggttaaaaacagacgaaaggatcggacaaatgagttggctacagatctttttacatttcccattatatttttctatacctctttaagaaaacacaattagaaaatgatttttttatatttttcaattttcttgtgtaatttatcttaatttaatatatatatatatatatattaattttaaattatgatagaatctaaatttcttttatttcttcttaggaatagtcttggaaaagtttatatacaaggaagcaatggaactactagaaatgcggctttaagataaataaataatatatatatacatatatatatatatatatatatatatgtatgtatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatttataacatttttataaaacaaaattgtactatataatttttcaatcgttttcaatgcctaatttactagagaccaaaacaaaatgcccattgtgttcacaattaattgtaggtaaagaggcaaatcagacacaacacgaattctttcccataggtggcctaagtccagaagacaaaaatatcaaaaacatcaaacacaatcctataagatcaagttgttagtcaattgacacaaaaatttccttgacgaaagtcagatagaaactaatattttactagttcttatttataccggtgtgtttggaatctgttacagctcagtcaaacggagattttttcactttatcatgagcaaactgcaaactgagaaggagggtgaatctacgttcaattcgactgaatggaaatacaaatacacttgtgcatttccgatttgctgttaaaattactaagatacgtgttctaatataatctaacatgtaaaaataaaatgaaagtaagaataaggatcctaatccttttgtaaaagtacttttgccttaaacatatttttacacgtgattattattattaaccctggacagtgaaaccttcctcaagtcataacatcttatgcttacatcaaacacttctgttattttcttttctttttcttctttgtccaacaagaaatatgacaatttgtttcgttcctcttcaaaataagctctgtttttcaattgccatgccaccaaactgacgtttgactagaagtaatagtttcttacttctcattgaactaaactttgaaaggtgtgattttccaaacgaactatacacaaattaagatgtgtttggtttaacgtttagttgaacatacatatatttttatataagttttgtaagaattagaaattcatagttttttattcaacggccatttggagatttttcgacagtaaaccaaacacacattaaatatacactacaaacaaataccttccttagagcttattttcttgaccatcaaaatattaaattaattttcagttaaccctcccaattttgtattagagtgaagttatttcataaaatagataaatgtttaaaagtggagttgtcattacatctcatcaaatgtacactaaagcttctcagtgcaatctagtgtattctttaatacgctgcagattttcatctatactccttcatttcttggttttcattctattaatactagaacatcaacagtatagatgcataagaggtatatcatatgagacatatacaacaacaacaacaacaatcactatgttgctccgtatatcatatgagacaaatacaacaacaacacctccttcatttcttggttttcattctagttatgatttggataagtactactacaaatcacaaatatccaatttatgttgctccgtttgtcacgataaacagtgttaaacaaatagactgtatacaaataaataggatttcttatttcctttcatgcctcttatcagatgctttatttggagataaaggtcgaaaattacaaaaattggaatagatatataatataaacctcaacaaactctatatagatgatatgattttacttcgtgcgtgataccatatataactccttaattatatgtttcttgaggaaaaagaaaactttaaagctatgttttataagtggtaactggaattgtgaattcagcaattgggttggggttgaggattttcccagggggtagcattcttgccaatcttttgaataactctaatcacttcttccgttgtgacattgcctgtaacgatcactttgttcaactgcttgtccacgttatacgtctcaatatctgcaaggtcgcgggtcgaaaattattcatggaaccgaaagaagttatgcttgcaaagcaaattacactttgtagcaaagagatcatcataacaaaagttgtgagatttggaaattaattagttaccttcaatcttcttgatagccttaagaattttcttgatacactcgtcacagtgtaaaccaaccttgacttccaccacctgatgatacacaacaagaaactttgatcagttttctgtcccatatatagctgaaaacaaagggatcaaataatagctagtaagtttctgacatttgccattctaattgtctgagtggaaaattgatgcaaagttaatgtctctgatgttagaagccttgagcaagtagaagaaagaaaaagggtagggtgatttttactgttttaggcacagtgtgacatacagccatacttatatgaaatagcaattagtgaagacagaatcggattctgtacttgaaagatggaatccctcactttctgtcaataaaaggtgcaagaaagtttattcttaacagttgacatgggagtaactggcctccactcattcggtaaggttggcaaccacaaagtccctgttgggtttggccaaaaaactagtgaacaaagaagaagaggaatgaaacaagcaactaatataattcctccagctttcattagatttgtgacatttgtctactaggataacaaaaaaaaatgctaaatatataaattcaccattgttggaaggttccatattgtctgtctcaatttttaaggtgtaaacttatttatatatttgttggacaatttcatttaatgttaattagttttaagataaaatctaatcactataatggataattcaattataacatatattatttcatatgtatatatcaagaactgaacttataatcacatatttaaaggttaaaattatttatcaatcatatcaatcatgtgattcatatattttatgacgatattgttagaaccttaacttgtgcatcacatttgacaagtatcatgctacagttttatttatttatttctgtaaaagtgaattggattttgaagactcggtgtggtttggtttcacttctataatcatcaaacgtgtattttgatatgcacaaaggtgagtttaatatgaatgtgaatagtaacagcaaatgggcctatctaaaacatgtttggtggtattatcaaagttcctaggtctatgatattcttggattctttggtgagtacgatcaggtggatgctccttttcatgaattttgggttatgctgattgatgttcatgccttgaatagacattcctcataaattaatcatacacttgaagctcttgatcacagaccagaaaagcttttctaagagagtcgtccatttgttcaagggaggattcaattcattagatttctataatgttacttttttgcaacttgcgttaccttaattacctaagagagtcgtccatttttatgaatttgaggtagtaatataaaaaactgcctattttccaaatatgaaaaatatattaaagtctaatttttattatactaatagaatccaaaagtaatccaaaaataatcatttaatgaaactgtgataattcataaaaaaaaaagtattaaaattagtacatcaaattaaaatgcaccaagggtgtagcatggttgaacagtgtgcataaaccctctaatatcatctttggtttctacatataaaataaataaattaaaattcaatagattaacaattcaaaatatattttttaaaagtatcttttaaaataataaatataaacatttaatatcttgtaaggctaattaagatccattacacattgtatttgtaacttaatttgaataaataatataaaattctgattactttacgtgtatctaaattaaactcttcaaacttcgcacatgccttggtacatcctggaaattttaaagatagtatcacattagttttaaccacgccatcaatggcccctaaaccaagccataatttcttttttatactcaaaaagcgtttccaacatttcacgttaaaccgttgacgaagacctgccacagtttctctccaacagcatcatcataacaattcgaaaaaaataagaattcaacacaacagccaatcacaattcgacacctgttctttttttctttttacatttccctctgtaagtgtaacccgatcccaataaaaataccagattcgttgccacacacccctagattttctccctcttaatctcgtccaatttctctcatcaaagtttcgacctttgataaaattcaatcatggggaacgccctgagattcctctacagccattgctgcaagcccacagcagctggtgattctgaatcacttgggccacacggtgtttcctctgccaccgttggtgtttcagcacttgcccatgatctctttcgctttgacatcacctcccaggtacatgcatacacaacacatgtgaatcctccaatttggaacttacactttgggtaattctgttttttcaaccaatttggcatattggttttgtcaggtctttatgttttcccttttaaaatgtttttaggtcccggaaggactcagcaagcatgttgtgtcttctaagaaggctcaggctaattggtatactcaccacattcttctcactatgaccctgattggataaacttaataaacacttgggagaagaaaatatgaaagtaaaatgaattaaacaacttttataattaagttaaaattagcttatgtataaggtgattatacatgttctctcatttaacttctctgcttgccgatttaacttactagagaaacttaattcactttattttcttattttcttctcctgagagtacttattgagaagattatccaaacgggacttaaattgaatactataaaaccttcagaagcctttacctttgaactatgtatgccctttctgttccttacaatgtttttgaaggtatagaaagttagttgatgcttggaaagaagcaaaaccccctcctacgacacctgaagaagctgctagacttgtcattcagaccttgaaaaggcatcaaaaagcagatgttgaggtttgcatgtacttccattccaaactatgaatttgagtatgttacctaagtcacctaatcacaaaaacaaagctcattggggatggaatttgtgttgcttaatttatagggattgttggctttctatggtcttcctctaccacacaccctcgttcaaggaacttcccaacccccttcatccttgcctgatggagttcaatttgaaatgcataccttgccggtaagaatttaacatttccattcaatccataaaaataaaaagtatacttgagctgaaaatgtggtagttgacaacatgatattttcaatgggactaggttgatgcaaaggcaatagcagatggtgacactgtaacagtctatgttagcacaacagacccaagagaatcagcatttgtccctggcaatgtgcatgccgccaccgtgcgaagatcagaagcgcgtgcacgaaggaactttacagaagccgatgcattgcacaaacagatcattgattcaggatatcggttggtttgtagtttcccaattccttatgtctatgcttctaacactccatatttttcttctaattgtttgcttatttagggtgattcctgttcaaaacgaggaaatcctagctaagaagtataggattcgattaaggtaatgtctaaacaagcactagtgttaagagtgttgaagttgttgtggaagctattaatgaactctagaaacaaaacaggggaattgatgcaccagaaagtgcaatgccatatggaaaggaagctaaaactgaactgaccaagattgttcaaggcaagcctttgagggtccttgtttatggagaagatcgctatggtcgttctgtaggtgatatctattgtaatggcatttttatacaggtattcatttcatgtatacattttgtcattttgctctttatctatatacattaatacatgtttgatgtttctactttgtaagtttctcattttgcttttcttttttgattaggaaatgatgttaaagaagggtttagcatggcactacacagcctatgacaaacgaccagaactggaaacagtaagtaacccatgttctggttctttcattatttttcaaaggtatatatacatcctaactttcttaagttcttatgttagtgggaaaaacaagccagagcaaagcgtgttggattatgggcttcaaaaaatcctgagaagccatgggaatggagaaaggccagacgagaagctgcataacagcgcctaaaatcacacaagcagaattaccagagtgccaaaagaaattgagtttctcagtaaattctagggaaaaactcaaacaaaaggcccttcattcattatgtataattgatttaacaaattgtatgtatacaaaacaactgccaactaactagatctatttttcaatggtatgcttggatcattagcaaatctgattttaggcaccccaaacaattttttaccaatacgcttgcacagttagtttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataggtaaagaggcatgaagtgcctctctccattagtcgttataatgttgatttagtttttttacacaaaatagttgaaaaaatgagactgtttcgcatatcagtttcatttctagataacgtagagattaaaatcaatcattaaattagaatattacttcttcaaaattgttgtgtttaataagagtattgggtaacaaacagccatttacaaaattttctcttcagctagtgcagcattttctcttaacgtgagataaggagaaaaatgaaaattaagggcacagctcaattacatacattcaatatgttcaatccaaagctgtggcttaattagttggtctctctatctgatcttaccttaaaactttataagatcatatatgaatcataatgatctgttgttttttttaatatttgttttgctaattttttaaaatatttagttataatggatttgtgaatatcatgttatgtgtgcatgacatctaaagtgccaaaaaagaattgaaaaaaaaaaaaaacctaaaaccaatatattatcttatttcatttgatgcctttctgttagatgcttttattcggagataaaggttaagaataaaattgaaatagagatatacttatacctctgcaaactcgacataatagaatttcactttgtgcgtgatatataaatctttaatttgtatgtttcccggggccaagaaaacttgaaggctatgactgtgtttggaaacattttttttttaatccataaatgttgtattttgagtttttatatttttaattttaatcaaataattgactagattcaatatttgtctattaatgatgcaaaatttttaaaattcaacataaataaagataattaagttgaacacattaaagagatagaacacaaacgcttgaggtggtaattgtcggttgatgcaattttcgtgacgtgttgggtgttcgatctattgaaactactcttgatgtaattttagagatttttttatcatttaaagttatttcaattattaccttcattcgttaacctaccataatcatgatctctcatgtgaaagagcctaaattacctaattctttcctaatcccttaagagctacatcaaataatttgctttaagaataaatatgtataattaaagctaaataataccattttatccctaaacatgaattacttagatacacttttcaagttcttaggatgcaaacatttctcaataagtaaaccctataacatacatctgcatgagtgatcaaaccataaacaagacaataaactcataaaagaaggaataatattaaaaaaacattaaatggatagtgagaatcattacatcaaaagtgtttgtttgataagcttccaacaatggatgatttagcctctcattgtcatgagagacttacaaatacaaaaaggaaacaagaggaatggaagaaaatggaagaaaatggaggaaagggtcttcaagtgagtgagtttcatcccttctctctagccctagccctagccctgtgttctatctgaaatccccttttggcatagtgttttccctctttttatcttcaaaacgctacacaataatgttgttttgacaatgaccgtgtgctaagcatgcatgtacgcattgagcgtacatgcaaagtccaactaacttaagtgaccacgtgctaagcagtcagatgcgtgcagcgtgatgctccagttcttcaacatcttccagacctcatgctatatcactttttacaaaaaatagaatcaaaatattgtaaattttctaactttagcatccactgaataaaaattcaaaaaaaattaaattcctaaccttttaactcaaaaaaaacattaacagattaaaaaattaaataatctctatgtgaattaaatatacaaattacatatgcataacaattatcaaattgtttgttaaatctataagtctaaaatataatttatatatactatatttaaaatatttgtttattataaattttagttataatagaatttatatattttaaagtatttatttgttgtgaattacatttaaaattataatatataaatataaatctttatagaggtgctatacataagctaaaatactagatatctttaaaaaaattatgattatgctattatattcaaatttaaatcaaattaaatatttttataataagttgatttattaaaagataaaataatgtgattttaatttacataattaaataagtgtatataaataatatttatccatacatttgctggagttaaaatgcaaagtaaagaaattatatttcagtttaaaaccaaacaagtgtgataataaaattaaatcggacagttgtgtcctaaaagccctacccaatccaatacacaaacataaataatatttttaacaaaagatgctgattgctgagattgataatagttccttgataaacaaacataaattaaatctattgttaaaaaaagaatatctgaaaaatattcactagattattttataataaattttttaatctataacaaactgagaatataacagcaaaattacaccaacacaaacggtgcgccttgtattgagcgacgaaatctgtacagcatcatttcatcaaggcttcggtcaaggctttgagatgagcagggaaactccacggcagtgaacgggccattatcaaatacaagttggaaaaccaagattggttatatatacacaattatttattttattctcacaagaagtaacacaagttaagatttaagaatgtacaatgctctctacaaccatttcctctgtcgtttaaatcaattcacattggtggaaaattgtaaagaaaacctcaaacaagaaagaaaggactttggtttcacacagacatttacccaattagttacacaatgtgactcataatgaacatctaaaatgtacttcctaacataaaaatctgggttgattatgagagagctaagaggataaaaacatgaattaggataactaaaaatttaatggaccatcccatataacgtcatgtttatggaagcagaaacatccctggcttttaccttcagggactaaggagattctctttgtattgatggaggagttggtgggttcattgtttcatcattgccggtttcagatagctcttcttttacagtagatagtggcctctcagggctataatatcccttaacgaaaccgcttgaatttagaggactagatggcttgatcatagaaggggaagagttgttacccaaaggagaacttgtgccagatttgcttgacgtcacatcttcacgaggcaaaggtgacattagttgttggtcactagaataaacttctttcctgcataatttatcttctataatatcatagctattccccgttcgcacttcttgagcaagagagcaccagcaacagcataaccaaagtgtgcaatcagaagctgaaggcttgccgaaacagaagttataagaaggcaaactgaacctttttctcatttgaatcctccaaaaaccaccatacagaaaaccaaaaagacacagaatgatcccagtagctactagagcctgcctaacagtttcatcctcaatattcacagcagccaagataaaaatccaaaagggagccatgcaaaacagcataaaagtagcaatgtgaacatacatgtttccaaagccaagtctctccatgttccaaccaaagacacaaaaagtacagaaaagtgataggtatgcttgagaaatatcattccatatgtcaagtattcctccactccactgtggtctagtttcgataaccctttgttgctgtctggatgcaaatgaatatttcttctgaaatgatttcactctcagcggctcttgcttctgagcaacagaaccttgaacctgtgcttcttcatccatctcagaatcataatctttacctagagggctgagaatggaatacagaccagcgactgcaggtgcaccaattgcaacagatatgcatattccaactccaatggccgggcggtccgatcttttataccctaagtttagaccacaaagtgcatattgagcaaaacagttcacattaaggagaatgatcactaccatcatgtgtgcccattcatggggcttataagtcccattcttgcagtaaacctttctaagtcttgagatatcttgtggactccgcctgcacagtagcacaaggtggtagatcctctttggatgctggtacaaacacatgagtgtaaacagtgcattgagtatttgattgttcacttcaaaccatgcgtttctctgcgacttccttggcagcacagcattcaacatgccagtcatgacaaggaacagaattgcacctgaaatggcaacacacaaaatccacacaaagagggctatgttcattgggtccctaaaccattctacacacatcttcttgagtgaaacccagtcaagtttcttcgcaaacatgccactgaagcgctctcttaacccaatagaacccggagaaggcacgccttgagaaatctgttccttctcagtagcaggcctcctgaatttggcagatgcagaaccaaatttcaagaagttgatcctattgggaatagaactcaaagtgccctggaactttctctgaggattttcattgccaaccaatgctcttcgagaagttgaaatatctatggaagcaaactccgtctctttacttccgttagattcctcaatttcatctttaccactatcaacggaaaccattctgatatgaagcctgagccttctcaatcaaaaccagtaccttataatcaatgttaagaacaaaatcagagtggataagaacagaacatttatgctaaattttcaaatccatatcaaatttcatgtgaatccataagcacaaagaaaaaaaagatcagactttatgttaatatatatgtgtcgacgacccagtacacagatcattatacactttaattaattaaaattcacaaactataaaaaaaaaatataattctaattataccaacaaattcatctcaaggaaaggagtaaaaaaaaggaacaaaaacatcaaactttgaaggtatgaggagttaagtgcaagtagaaaggtgtcctgtaaggtgagaaaagaggaagaaagcgttgaatccaaggaagagttatattctctgcaaaaatcacaaaacaactaacgaatctaaactctggaaagttcaaactgtacaacgtgaaacaaagtagtacagttagatgtggcaatgaaggaacggtttctcagaacatgatccaacaatttgcttaatgcgacttccgagaaaagtaaaagggaaggacaagttgaaaattttatttgaggggtggaaattggaaaatatatttaattatttatttcttcttccgacaaccatgacaacagttatactgtgtggtagttgtgtcaaaaagaggaaaataaataaggatatagtatttttggttttcattatttagatgagtgaaaatacagacgaaaagaaaatttggagatgggacgcagagtttaaataaaacaagaacaaaatcacccaacatgcgtgaattgagaggggaggtggctgaattattcattagtgtttaaaaattaaacaattttctagtgatttcttttatgaacaataattttctattcattcaaacagcaaatttttactttatttctatctatattattcctattatatctttctctcttaatttactcgtttcaaaattcaaacacagcgtgaagaaaacaaaagaaaaatgaatttatctagaaagttgtcattgtagaaggcagagacgggtcccactggccactaacatgcccaaatatgaaatatcctctgcatttccctttcgttttgcctcactcgttttttttttcaatctttctctataaggataaaacttagatgatttttaattttctataaatgttttaagtgatggaattcattaatatcaaccaagtggtgagattggaataaatataagagaatatatataaaaaaatgttttgagtgtggctctcaaattataattagagttttcgaataatttatatataccttttaataaaatatttattacataattttttttatggaaaacttaagatatttaattcataatcaaagatcgaatacaaaaaaggagcataatcaaagacttgttagggcttcacaattttttgcttgtattacataagttattgatgaaatgaaattttaattaattaaagaatagtctatataaaaatatctataaaattgtattcaagttttttgttttatttataattcatgattacgtgatcgttacttttcatgccccttttcataatatatatgattgattttgcgggaatttttttcttaatagtatattttaaaactcatcaaatttaagactacttactcaagagactcattaaataatatattcttgttttctttatatatatcttcgtttatgtcggctaagttgagttgagcttccatgaggtgcacataacagatcatgtatgatgcaacgactcgctggttctatatagttggcctatttaaaattaaaataatattgattaagatgacatcactttgaagagctatgtgatattgattatgttggtgcctttatctgattagctgcttcataatattattgttaaattactattataacaaatatctagctatagtttaagtatcacactgttatttcaatttggaggagcttgataagagaaccaacttgatgtggccattgcccaatgcccatatagaatgccattggtatttattggatgataaatcaaatgtatatgacatacaattatatttgtaaaagagagtcaataggatctaactcatttgattaagtagattgtgcgagttattgtagtttttctatattatttttaattcttacaaataaacaaaatatttgtacaagagaggtgagcacttaagagctaagtaacacataactgaagattaataacaactaagctacaactaacatgttgacaatcacacaaacactattactctgtattttatttttctttcaaatcaggtgaattagctcatgaatccacttgacatctgttcaagaaaataaaaattatttttgtcctattcttcttaaacaaatttctctctctcttttttgggtccaccttggtaagcgaattcaaactatgatttatgttcagtttgacctaaaatatgtagatgtcatccatgactaagtacaacagtattaacaaaataacttctgtttgcttcattttgtgttgagtttaggttggtctaatattcccctccttagtcaaactactaataaaaaatgacaatcaagttgtttccgtttgaatgagtgaattaattagaatgtgaagattttataattacttgaattacaaatgtggaatgaaacccccactaaatttggtcattcacacggtatggaagacatagctgaagaaccgttcctctccttgtaattgcctttcctagtagttgagcaaaagataaaccaaaatcaaactgaataatgccgtcgcaaaccatggagttgccctggtgattatggataatttttaggtatgatttttaagtatttctagtattattttacaattaaatttggaattctatactagtaattagcatcaatcattaattttaatcttcatttcataaagtatttgtgatactgcacataaattttactattgattaattcttaaaaatgatctcagttaacattttttttaatagtaaaacaaattttattagtaaggatcaaaaaagtataaatttaggcagacccttgcacggttgcaccaagatacaatacatgtgttgtttgacatgcaaccggacctacaatacccaaattaatgcaaaacacattattctatcactttacagttccaaaacggccaaccattgtattatgcttgaatccaacattttacgttcctcattcacgcgacttcaaccttttcctagaaagcatcaatctttcatttgcagttttgcgccaaccacatgcaattttcattataaatgtcacatattcctcatttacctgtttcacacttcttgcattctgcatctttatacaccccacattgatataaaaaaactatatatggtgcacatacaaccaatacactcattccattctacgttccttgcacaccatgcatcatcatatccacgacttgccttccatacccactcaaaaaaccccttcatttttttggcacacccttgttaacttgtgtctcctaaacaaaccaaaggatttataagagtcactgaataaacaaatcttccccctctgagcctaatgtaggtttttttttttttttccaaaaacaaccaaactctctccttctcccactaaggaaactccaagatataatatgtatggtttttttctcaaactttatagaattatttgtctctcatatttccacaccacaacaaagcatgctgtcctaaccttctcattcactagtgagcctttatgatctcatgacataaatgttatttaaaggatagagtaaaataatactatttttgcgtttaaaacaaatatttataactcattattagtattgatttttccttaatttaagatgtgatatgaaagattaacaaaataaaaacagtcaaaaaaacaccttttcccatatatcctcgacatttattatatgataatgaatgaaggttctgaatcttatatctcatttaaaaatcaaacacttgaatttatgtagttaaggcattattttaaagttttataactcggaccaacttgggtagtccgtccgacaccaggtcgagtatgttgttgctcgatctagcgagcatacttttcacttttattgatattttttataaaataataaaatctatttcaaaatataaaatgattttttaaattcaatattttaaactaattccatttttttttataaaattactttaaattaattactttacactagggacgaatccaaaaatagataagtgaattgacaagtaaataaatgttttttccatcagatttcaagaagtaaaaaataaaaaaatattataaaaatattttttatatataaaaaatagaaaatttattcaatatttattttatatggtaatttaaatatttaatatcatatattaataatttcgcataatgtattattgaaaacataataaacaatttcttaaataaatactatgtattttatgtataaaaaaaagtatcattaagtagtttaaccaatacttgtaaacaacaagtggttaaaacttctcttaaaactaaattaaaaaataaagtaaggtcattggaaggaggcaactaagtaaagaaacacaacattaaattaaattaaaaacacccacatattattcatgcttcaatttcatttttcctcctcctctcaattagatattgtcaatattatatatataccattgaccaaaataaagtaaggtcttgccatgaacaacaattcctttgggttttctgtttttctggattgattttaattttgatgggtacaagaatggctagctcatctgaatattgggtgttttttggccccaagcgaagtcactagatttaaaatcagccttggaattgtccataatattttgtactaatgtgagttgttttggataattttcttgtcaagattgaaatgatgcaggtgaagagttcacatgtattgcttaaattatgtggatgttatgtgtcgagttcgaggttaatgattttgatgcatgtggatgtcgtagggattggtactggtaatgaacatgctagagttgatcgaagaatttgtgttgcttatattcattgtagcagacattctattttactatcagaaatatggcttccatgaactgcagtaagataaaaaaaaatacataaaggaaaaaaaagatatctcgaccgataatacaaaatgagaagataaaaaaaataggtgttttgcctttggatatgagtcataaccatccatatgaagctttatcctgatatgcttctccatgttcttatatttcatgttagtctttattgagaaacacttatgagacttgctttccctttattaagaatttgtacattcattttgtgcattaaattcaactatgaacttatgtattggttaaccactaatgaatgttaagattgtcattttaattgttatgcatttgggcgttgtataatgtgcatcaaactcttttttccccttttgcataaagagattgctctttacacaacctcaaaattttaacagtgaattttgctagtttgacattcatggggatattgatccactttttaaggtaaagttatggaagttattccacattcctttgatacttttcatctcttaatttaacccaactaaattttttatgggataggattaatgatgtgaactgaacaattaggtatcttggtattatagtcacacttgctgaatgtcagaaactcataaattttgcttgtttgcatttagcttaagttactattatgctatatgggtttcagagatgtgttttgtaatgcctggattcatatttctattatatttatttctttgttatattcaggagtacttgtgaagaggttgcatcccaataatgtatgtgataaggtttacatgcaatctccttttcgtgagtctttaataagaaagggaaaacttagaaagcaataattagttcttacaaagcagcataagactgctcttatacaggacgtggactccgttggcaatagaatccactatggttgtcttggtttccttcctaataaacgccagataaagttatttctttttaatgttaatgtcactatatgtttgtttttagttttgaacattttgttttccttttttttttttatggaattctgtttttcatgtgggtgagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttttttttttttgaaaaactacttttttccctgtgttaatatgcttttggaaaggcttttggcttttagtagataacttgtctttcattaggtaattgatgttgaatggtggatcggacaaacccaacaatcatggagtatatcatacatgtgttaatttcaatattgacgttaaataatataaatgaaaaaaaaattcataaataagcgagatgttaaataataaaaataaaaattaaataaacaattattgaaaataagttattaacggatggattttggacgaatatttcattcgaaaattacaaacgtatcaatccgttgaaaattcatgacggaaaaatctgtcggtaatttctgacttaacataccgaccgaaatatccgtcggaaattaccgacggacaacaaaattttgtcggttaaaatttcctacatgcattttctcgacaaattttaagggttagcgacagatttttgccatcataaattaattttttttgtagtgcaaatgaggtaattttccatttgtgagatgattatagggatctttacctacctagatataatgtgatttggggtgcaaacagactaggtcaggccaggcttggttaggcctggccttggcctgattgaaaaatataaagtttggcctgacctatttacctgttacaggttttttttaagcttgacctgacctatttaaaagtctgttgcctacaagcctattaaaaagtttatttttaatagaaaatttaattttacaaaacactttaaatcaatttaagaaagttaaagaaataatttttaaacaaaaaatgtctcaacatcttacttatattttcaaataagtaataatcattttatgagattttcaaggtgattttttgaagtgattgatcatctattttcataatgatgaaaaatatttttagaaaaataaatatattattttttaagttttaatatatatatatatatatatatatatatgtgtgtgtgtgtgtgtgttaaataggtcaataggtctaacatgtttttttttaaagcttgagctggacttttttagttaaacaaaattttcaaaaagccttagcctgatctttataataaacaagtcaggccaagtcaaaggtccctgataggcgatctggcccatttccatccctaaatgtgatgtgatggtcttgggctccctttaaaaaaattaaaaaaatagaaagcaccacattaaggaaaatgttgatcagtatgcaacaaaggaaatgaaaacctcaaagaaagaatgaatatcatcgtaaagttgattgtggtaaatcatactattcacttatatttctcgtaagaaactcaacatatctaagctcaattgcaccccaaaaataaaaataaattatcctacctcctataagaagaaacacatggttatttccttttatatcttcaatttattatgaagtcaattaatgagttattaacaatatactaacttattctcatttcttgaaaaaatatttcttgaattatgaaagtgtcattatatctaatcaccaaccaattaatcttaaaggaacatctttggaataaaatttaaatttatgtcagtattgattaaaaataactaatttaaccatgttccttgatcttgatgaggtagtattatccaacaactatctcactcatctacttatacaagcaagctatctcactcgtccacttataaaagcaatcattatagtggctctcttgtgtccacatttgtcataattcaaaaagtatcaaattaaatggcttaaaagaaatagtattatgagacattctataatttatcaatacgggagatttttcaatctctttatgatgacaactcgtccatatatgcagatccaataaatgtgtggatcaaatcagactctagctacctcaacattcatttcaagaatatatgtagactacttcaattaaaaaccaaagcagatacactttatattggtagtaagatgaacaactagacaaacaagcataatacaagacgacaaatcacatgaaatccaaccgaaagaagactatgtgcaatcaagtcagatcatcctcctcaagttctttggctttcagcttttctttcaccctcaaaagaagggttgtcttccaagaatcctacacaacattcatgcaaacatgcaacgttgatcaaataccgcgacgaaagatatttatggaatgcaaatagaaaaattgatcagaagaaggaatctaagttgacaacggttcattactcagttgaatatagttacacaaaaaatagtgatgattatttttcctcaacttcctcctcacaaataaatttgtgatttgattccatttagaagtgtctgacctagattttccaatatgtagaatgtgatgaaaagtagagagagagcaagtttttaactaatattttttcaaggcaaaagaggttagcggaggcaaagcaactctaaacatcaactatgttggtaccctcaacgctacaaagtcatgaccagcaaaccagtaactcatatgtgcacataacgaatcaatatttcacgggaacattcagagcaaatgcaaattagagaaaataaagattattaaaccgttgtaaatcggagtaaatcaattatgacaagtttattctgctacaagatcttcactatattggaaaaattcttgttatataacaacaacaacaacaaagtcttatctcactatgtcaactaaaaattgtttcatcttacagcaatttagaacttaccaaaggggtcatgctatcaaattccttgataacttcagtaaactttccaacatcttcttcatcaattgcagcagcaatatcctgcccattttttttttttaaatcatcaatacttcagaaataaatgagcaatgaatcagtacgtgcaagaaatttttttttcataaaaccaaacattaataagaacatgatagcagaggagtcagttattgaaatttccaaaactagcaacatactgccagaagtctatattcacgtgttccagaaaatgttggatccaagtcctgcataaacaaaaacatatccaaagaatttagaaactggtgattttaccggtctcaagatgtaaattcttgaaaaatattggacctgatatcgctccaatgcattggtaatagcaataacatcccctttacaaagttggcaaatgccagcattaagaagatgtcctttaaccccatacttcagcaaattattgctgagagactggcgagcaatatcttcataaatctcaattgacctctgatatctggagaattattaaaaaaaaaaaaaaattgaaacagttaatattcaatttaacatacagagaaggctattataaagtttctttcataacaaattgttttctttacattattctagagttcctgctcaaattgaaaccaccatacacatcaatgtaaagaaaaccatgtatacatgtcaatagcaaatggactaatttttgttaaaaccatgtatacatatcaatagcaaattcttaaacttgagcagatgttaggggggaaaaaagataccaaaccatgatagcgggtgacgtagaggaaggccaacatactaaacaaaaaaaaaaacttagtaaccaacaaacatagaacaatagaagaaagacatgctcaataaggccttcacagttcacgtcaacaaacaagatcaaaacaagcagaaaaatagaaagtcttactgttctagctgggcagagaattgagcaactttttgcttgcactggtttgcagaagtgttcacttcttcattttcataaaaatcagctgatttttcatagtaaacaacggcctgctcgatattctgttcagactcatacaactcagcaatttcctgcacataaaaaaagaaaaatccaatccaatcatgatacattcacgagaattcctggaagaatgcctcaaaaaggatagccaagtggaaaaggacaccattttataaccaaatatgcattagccacactaaaataaagaaattataagctatataccttcaaatatctagcagccatagagagtcttccaatctcacagaagatatttacagcattatctaagcaagatacggactctgcatcgaaaagagagagaaatagaaccttaacatcgaacttcgattaagtgatggcacgcattatataatttgatcacgcgcaaaagcatatatgaatttgaccacaaacatacacacagaaaaatatgttcaattgttcaaaaatcataatcctaatgtatgtaaactgtaaccacatacataccatttatattagtttttttatagcaatgcgcagcgtcaacataagcttgtgcagcgtcatgcttgctttccaactacgacaacacgattcatcacaacaggtagagataatcaaatcaaagaacacaaagtaaataaaataaaaatccagaagttatttagttagttaccttcaaattgcaattcgctaatttgatgtaggtggatcctgctttgtcccctgaaaatgtgaacaaattcccgtgacaaccttaaccaacgtattaaataaaagacgcaaaattaaggttacatgatttagcgagcttataagaattggcggatttgtcgaagagatcagcagcgtcctcgaatttggagccaaacaagccccaaccgctgagcttcttctctgccttgttctcaaaatcctcggccctcgccaaatgatcacccatattgtaatgaatcaatcgatcaattcaattccctctctatcatgcaatctatgttaatgttaattgtttttttttttttttttttgagacagagataataatgtcacagatagaaactattcatcaccaaattggaatgaaaatgaaaagctatgtgcgtgcacaacaaaaaggctctatttctgtttcacacgtcaattcctcccattcagaatatgctttcccctgggtacgttcgttcggccatttcattgggctaggcccatttagtaacccagaaaacactgagttcaacttcatgtctaaaacctctatttaaaaaaataattacagagtgcttatttaaattatcaataaaattaagcaataaatgattaatatattcatattaatattgaattatttggatactattcaagttttaaatttacttatcttccgacagaacttcagattattcgatatctctttttccttattaactaaagaggattaaaactaaaaaatatcaataaaattaattacattaaatcatatttgtaattttaatatttatgattaatgaattaattcaaacattgaaattaaaattaattttttattacatattatgtgtacgaaatattctttgattttgactatgatcaatttttagtgaaaaatctaattaattatctttgagatttttctacaattaagttttttactcacaatactcatattcgagaacttaaaaaattcgagtccaactttagtcaaactagaaatgttaacaattgaataaaatgtactcatagtaaaataattccttttatttatttaatcgtaacttatcattaatgattagatttttaaattttatgataattaactaattattatattgaaaatcatatttaaagcggtttttaattgactgaaaatataataaaaaactttacattaataattataattaattatataaaaaaatcttataattaattatagttaataatttaaatttatgacaaatatagaaaacctatccttcccccttacggtccataacgattatccattgcattcattacaaacctattctcattaattttgatttttgaagggcatatttgagaaatttgaattgagtgagtggattaagatatgaatcagcaagtcgatccaattcccaggataaagactaggtatctcaaaaggctggttccagatggtgaagatgacaattacacgtcatagacgatttcaaattgcaatattttccttgagacacagagaataatacacgtgggcagagaattatgcatggacatttggcgagtataaaattccaattttttttaggaaaataaatgtttgtgccacctagtagataatgtcttttttagaacaaaagtttatttctcaataaagctaaacgaaattattaactacttcaaattatttatttgatttgataagaattcgtgaataaagaaaaaaaatattttccttgcagatcacaagtaactagaataaaaaatcgaatcatttattttgatcaaagtataattcttaatctcgtgtattaaaaaagattttattaaaagaagtatattttattgagttttcattgtaaaaatagttttagaatgtcagtgtattactattaaatttttaaaagaattgatttgagtatggagtaagttaaaaagaattatttatttttattttttactcaagttttgtattcttatttttttattagttttttgtatttttaattaaaaacagaaaaatatcaatcacaaaaattagtgttaatcgggatacttttggtcgggaattatatgggtttgcaggttctattagacacccgacatcacttttgtggagttgatggttatttttagggggttgcaaatagtttggaattataagaaatcaaatagtttattaagactcagtttatactctatccttaatcaatgaggacaatagaagtcacaagtatgctgtcatcatagaaaaaagaaaatacaattcaagatttgaagaatcttgattgagttgttcaccttgtccatactaatttgttggagggtaatttttgtgtgccttttctggctaagaagagcacttcacaaaatgttgaacttgtacgttatggagctctcccacacacacttgatgttcttccatacctttacgcaaatattatgttcatattatttgtgtgtagtcttttgttctttttattttcctaatgtaccaaaaaagaatcatgaaaattaattttttatagtaacttaaaaaaaatcaattagtgtgagagatagaaaaataaaagttcctatcatatagatttcattataaataggatatagtgaatgagtttgggttgagtttgataaaatttatgatctaattcaatcaaaattgaatgaattgttttagatcgattttttaagaaaaaaattaaaaacctcaattcatttgtaaattgtatgaattagattgtctcaacagatcaaaatatttaaatttatcttttattaaaaattaatatttttataagctaattttttaaatgaaatattaaatacattatttataattgtaacatatagtcaaataatgaaagaaaatatcaatggaggaatcacattatagttatcatcatcacatacattaacatactatgttaaacatgatttaaaaaattgaatataataaacaatttcaaacaccacacccatgaagtctaaattaaaaatccaaaagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataagttaatacaaattaatgatcaatgagttgatcaacggatccatatattaaaacccctgacttaactcaaaattccatgaatttgaatgcattgagttaggcttgaccctaatgcaaaaaatattcaatccaaattgtttagattgatttgggtcaatttaaatttgtggatgatatatatccataaacatccctaattataaattagaataattagtgaaggcattagtaaaaaataagtttataaaagtcttttttataatttattttatacatatatgttaattttaatttatagataaacttattttatgttatgttatttttttttattttcttctcttatacttccgtaaaaaaatatttatgaaaaattattttaataaattaatcctaaatcttaactaatttcatgttatttaagaagtgatattcggagttccttttatttaattcagatttgatttccaatatcacatttgattatctcatttgattcatgagaattgagatattaacaaaatgattatcaaaatagaaaaaaaattaaatctcattcgtatatattttaaaatgatttagtttttttcataagaaatgattgataaaaaaaaaaaaatactaactgagaaaggataaaaaccacatggacatgggcttgtctccatccactccacaacattcatgattcatcaacgacacgacacccaacatgaagctagaggaatccatgtccaactcccacatcactgccccgctccttccaccgaaagatccgagtccgagtctgcaaaatggatcaatctccggagcggtgttcaacataacaaccaccatgatcggtgccggaatcatgtccattccggcgaccatgaaggttttaggcatagttccggggttggtggtgatcgtgttggtggcactgataacagatgtgactgtggagtttatgctaaggtacacaagttccggtaaatcctccacttacgcgggcatgatggccgagtcctttggctccataggatccctcgcagttaagatttgcgtcatcataaccaatttgggggtccttatcatctatttcattattcttggtacgtaagttcatctcaccatcaattccttctctctatattgttttatctcatgttcatcagtaagttaagtttacttgcaactcaaatttttcttattttggtaggattaatttttgtatacaaattaaactgtccgaaaatgttgttgttgttgttgttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaccctacagttagtaagagagagagggagataaaaacaagaaaaatataaagatgataagtgaaatgatataatagggtgagaactaaaaaaatggtaatgaagtgtttgaagttttgtagtgttaaaatgtcattactttttttagtttttttttttatgacacttattcgtatttttggtgactttattcttgataagtgaatatccatggtttggtggggccacgttcggtttggttcagctacccattaattattattttttccttcctaaaccaataatttgtttgtaactataggagtaggtttaacaaaattatataatgcgcattatatacaataaataattattaaaatacccattttaaaatttagtaggatggattaatatgcatttacgtcttttaataatacattatgtgttctgtatgttggggtaaaaatataagaaatgttcatcacacactttctatttcactcttctaaatatattctcatttattaactaaatttattagaaataataaatatgtgaatctcattcttcatttttgttttatttttgtgtacaatgatgacaataagaatcctgcatctatttaatccctacccttaaatcgttcctagtaggttcactcttcatttaatacattctttttttttttaggaaatttaatacattcttactcatactttatatttttttataaaaaaattaaccaataataaaaaagtatgtaagaaaaaaaacttgttagttatcttttttatggtatacaatagtgacaaattaacaatgaggatgggtctaagttttcatagattttgcctgaaccacaccactaagctggcctaatgggttctcgctagccatactaaaataaacatttgaacaatggtcttggccataacaatcttcccttcaatgcaccgcctgtggcacaagtccacaaaaaagtttagtgaggaaggcgtcttgatcacctttaggtttcttaacccaagttacatcaccacccattattaatttgtgttagtttggtcaccaaaacaccttgaatgagattggggcaaaactttttcagctccacaaatcaattatgtgagttacaaggatcatgatcacaaccaaggttttaatatgtgatgccagttttgttgcgatctttgaaattgtgaaactgcatagttgatatggccgtaatttcagttgtgatcgcttcaaacaccttatcattacagccaaaatcagaaccctttcttagaatgttgatcagaattaacaactatgtgtggaaatgctaactgcattaacgatagtgatgttactagggaattcagggagcagttggaggaatggtggcatcaaaattaattaggaaatttcaagggtaggttgatttcatgaactatatagatacttcgaatgtcataatgtttgtacctttaccagacaactttatggacttacattttctaactattccttgtctatgatatatataaatttgactgggttcattggctttgttttggaaggagacgtgctctgtggaaatgagtcgaacggtatcacacacttgggtattctacaagaatggtttggcatcaactggtggacctctcgtgcttttgctcttctttttgttgcactcttcataatgcttccacttgttatgttacgtcgtgttggtcagtattactactatacccaaatgcacaagcaatttttcttttcttggcaaattaaacgtagcctttcatcttaggaacaattggctaattaagcacagtttatatattgttttcaatgttttatatgtacagattcactgaggtatagttctgcaatatcaatcctactagcattggtgtttgttgtaatatgctcatcaatggcggttagtgcattgttgtctggaaaaactcagacactgagaatagtacctgatttctctcaagtcactgtccttgaccttttcaccaccatcccagtgtttgtcacgggttttggattccatgtcaatggttagtttcaacattttataacttccaacttaattatatatcatcttttactttttcttttaatttgtcatttttcaagaaaaaatctatttatacgtatatgtaactattatttagatagtactgtattaagtaattattgatttgttaattataatatcataaaaaagaagacactagtgtttaaaatgttaaagtaataaatgggagaaataatgaacgtatgaggaagttataaataaatattaatataaatgaggagattaattatttatgtatatattataatcttcgaggactcataaaaaacagagaaaggattatttaacatcaattaattaacttattaatcccaataaatatcattttattcagttaaaaacgatggataaattatattttattcatttttttagatgttctcaacttatatctctatttatttaatcactaaattataggaagcttgggttagagttaaaaatgttaatttttgttactttaatttagaattattaacactttaaattgtgcttatatatttttcactttaacccgaattttagtggaatttagtgaacaaaaagtttataaagataagctaagagaatgtgaaattaaaagggtgtcaagaataaatcatccaataatttataataaaacacgcatatttgtttttttttttttttaaattcagttagcaaataaaagtggtggaaaagtgtaaaaggtgagaatggcaaagtttctattgtactatgattaacttaattacacatgacttggtgcagttcatccaattagagcagagcttataaaagttgcacacatgggtttggctgcacggatttcgttgataatttgcgtggctatttactttgctattggtttctttgggtaccttttatttggggactccatcatgccagatgtgctggtgaactttgaccaaaactcccatacaagtgatggtcgattactcaatgccattgttcggttaagttatgcactccatcttgcacttgtgttcccaatcatgaactattccttgagggccaacatagatgaactaattttctcaaacaaaaataagcctccccttgcatcagacaccccaagatttgtgtcactcactttgactttgctaggcctcacatacttggtcgctgtagccatcccaaacatatggtatttttttcagttcttgggatccacaaccattgtttgcacctcattcatcttccctgctgcaattgttctaaggtatactactaccaattaatttatatatactattatgcttaatttatatataaataattaatttacatcccattcctctcctcttctgagcacagggacatgcatgggatatcaaagacaaaagatcaagtgatggcaatagtggtgattgttttggctgtagggacaagcggaattgctatatggaccaacttgaatggttcaggggctgatcaatgattaaccatgatgatgttatataatacccagtcttctcaagttttagggaagcctaatcaaagatttaaactgatttagatcttctacagttgtgagaatagctgcatcagtctggtccttaatttgattaatttattaaatgataaatttatctttcaaaaattaatttaataaaaatttaaaggtgagattgagaattgcacatcttgtatttgattcaaacacgagtctgcttctaaggttataggtcctttccttaccacttgatccaaaccatcctaaattcgatctctttttcttccttttacttgttatatattatgttttaattttgttcaattattttctagaacaaccttttaggaaaataaaatgacacgtttgaataaatgagtaaatggggataaaaatgtaagttggaatacgtcatacaaactttttgaaatgagctcaattttgagcatttcaatttttattgaaagattgtctaaattctaaaagtacttttttttttttacaaataagaaagctaggatgatcagagaatgcaatttgataatgaaaagaccatgacatgacaatgcaatttgataatgaatttgacaggctcaatgcaaatgtaactcaaaaactttgataatctaattcatgtcattcgactctgaactacacaaaatcatatctttggagaggttgaagatcttcttacgaaatcattgtcgttgtataacaaggaagacagaagaaaggagtgtgagctaagtagcaatggcaaaagagtgttttttttataaataaaaacactagttaaaaaagtaaaagaaaaaaattgttggaagacaaaaaaaatgcactcccacatgatttttttaataaaatcttatttcttttaattatttaaccagttagggaaatggttagctcttatattaattcttaagatgttacttccttggccctcctatttataagatttttttagaaaatcatttatctctttaacaagatccttttttttttaattttcagaagcattaattatttttttccttaaagtatctttaattaattattctcttttcaaatattaactaattagatgagaaataattaaatagagagagaaagttaattttaaaaaaaaataatacttttgaaaaaataataaattattaataaatttaatatgatttaattattttttaaaaagtatgaatgaatcgaaaaaatcttattttaaataagaacagagagggagtattatcacgttttcaaaagaaaaagaaaatgaaagttattattatcactctatttttaagcttaattaatattgtctgtatttttactacgttattgattgatttcaaatgcaggagtgatgaccaattagagaaaaggtgcatgagattcactataatccacttccccgtccaagttcattttggttttggtgtccacattctacacgcttctcaccattcattctccaacctgtctcactcataatatataacacctgccacaagtcccacttcaatttataatcttacccttcactcttctccccaatacacctccacgtaatccattcaccaacggcattatggtaatccactaaccttaatcattgtaattcactccattttagaaatccaaactaaattatattcttaatgtattctatgtatttttcttaaattatacttaatatttcttttattttatatattatttttacttttttatgttaaagttattaattaattttaattaaaatatttgagctgacgaaattatctattaaaataaattacacatgtgtttttgtgtttttttatttttaattatataaaataccccttcttttttatttaatatgttattggtcttgatggacacaccaagattgttgatgtcaatgcgttcaagaaatcagatgtagcagtgatggtaaccgaagttatgacgggtatagtggagattctggctatgctggcagtgattgctcttgcgggagtgagtgcgcttggacgtagtgtttgtgggtgaagatgatgatgaggagaaatagatgatgtttggagaaggaggaagaggagaaggaggtggtagtggtaagtgaagatgagttgttgaagaaaaggagaatttataaaattcaaaatatgattttgaggaagaagatgaagatattttatatataaattttcattaaaagtcatatgaccagtatgtgattattaggagagaggaatctggtgtaatgtgaactaaacaattataagaaaatttttgtagagtgaaaaaaaagactatcaaatacaattacaaaaaaacaaaaaatgtgagttattctagataatattacatctaattttatatatagaaaataaaaattaatatttttcaaatataagaagaatcttattatttaatattattaggatattggttaaagaaattaagagaaaaaatagttatcgtgaatatcataaatataaaaaaagttataataacataattatatattttaataaattatttttaatttctaatcaatattttataaatattagttaatgtttatcttataaaaaaataatttactattaaattttattttatttttaatggttactctttttccatgaaaatgaatgtaatattaaattatcaccaaaataaagtacttttatagttttattaattaaaaaattatcttttaaaaataatcatattttacattatttaatgtgaagtgtaattttagaataaaaataaaatttatgataaattaaatttatatatttttattaattttaataaattatgtaattgtttctttatatatatatatatatatatatatatatatacatcccggaggtaatgctaatatagtatgcaacaactttagtttcggttttcacttttcatactcactcaccgccgggatgtcgccggtgcccggagcacacgcccctctcctcccgggatccaaccatgttcctccggcaactgtgtccggcgccgtgttcaatgtcgccaccagcataatcggcgccggaataatgtctcttccggctactctcaaggtcctcggcgtgattccggcgttggtgctgattctagtgattgcgtttcttgccgaactatcggtggagttcctcttgaggttcacgcgtgccggcgaaacgacgacgtatgccggcgtcatgagagaagcctttggtcccttgggaggagtggcagctcaagtcgctgttgtaatcaccaatctcgggtgtttaattatgtacctaattattattggtaagcaaatattagttacttagattcattatgaacttaatttttgttacttggactaattatgagcttatgctaattatttaatgtgttgtgtcatgtgtgttatttgatgcaatggacagcggatgttttttctgggaatcaacgtgaaggggaagtacacttgggtattttgcaacagtggtttggggttcactggtggaattcacgggaatttgctctgttcgttgtcttgttctttattttgcttcctttggtcttgtaccgtcgcgtaggtcagtgcccactacatttatgtttgatattccgtatttgggttttgtctttaatttgatcctattccagggaaattaatgtttagatggtgttcatggtagtcaatttttatattatgatgacatcggcaaattaaatcattaacgttcaatctcaagtccacagacattgttaggatatcatgtattcgaattattgtccgtttagatgtccgatcgacagtcacaattttgtgctagtaaagtgatttgggactctggactaccggaacacttaatatttagttatttgccttacaattttggttagatgcacttacttaagtgtttctactttctggtcttgttctataatcagaattggagtttcacttggatcatttgcaaaataaaagtttgtattaaagatcaagataggttactagatgaaacttcatttctaattggagaatagcatgttataagttttgtatttttggttattgatatgagatgtgcatagtcaggactaacatatttattttgttgtgccatgctatgctattgtttgctgtttttagagtccttgaagttcagttctgcagtatcaactcttcttgctgtggcatttgttacaatatgtaccgtgttggcaatagtggctattgtagaaggaagaacacaatctcctagactggttcctcgtttggaccaacatacctctttctttgatctgtttactgcagttccagtcatagtcacagcctacacatttcattttaatggtacctaattacttaccttccattttgttacaatattacacctcctttgaactttaaagaacctaaagatattttattgctgataattgttttaatttacttgcagtacatccaattgggtttgagcttgccaagccatcagaaatggcaacagcggttcgaatagcattgctgctttgtggtgtcatttacttttcaataggcctatctgggtacctcttgtttggggattcaacacagtctgacattctggtcaattttgaccagaatgctggttctgcacttggttcattgctcaatgttttagtccgtttaagctatgcttttcatgttatgttgactttccctctcctgaatttctccttgagaaccaatgtagatgagttcttcttccccaagaagcctctacttgccacagatagcaagagatttgtgagcctcactctagtgctgcttgtcttaagctacattgctgctattgtagttccagatatttggtacatctttcagttcatgggatcaacatctgcagtgtgccttgcctttgtcttccctggtgctattgttctaaggtaattaatctatatatatctctcatatttagtccttttctcttcatttgaacagttacaattgtcaaatagataaaaaagaatgttaccgacactctatctgatattccgtctacgtctaactgaaatttatttaaaatatcaattttggtggttcacatttttcatttgtttaatttatttttggaattttcattttttcataaaatgacagggattcttacggtatatcaacaagaaaggacaaaattattgcactgtttatggttatactagctgcgataacaagtgtgattgctatctccaccaacatatacaaagcctttcagtagcacctcgtaaatttgtgttttctttttccttttctatttttccccttatatagaaattttggtcaagggagagagagagagagagagagttgttctagacgcctttgattgttgaggcacttgggtttatacatttggatgccattattgtttgttgtaaaattcgtatatctagaacggagcagctatgtaaaatataaaataccaagcatgcatacaaaatgtgaaattgagatccaaatttagggttgaaagagcatgcatataatatgagatccaaatttaatgttgaaaggtgacaaagtttggccaacattattatttagtattctagaattccaagcgcaagtacaccgcgtgttgacatattggtaggtggtacccattattgagaacagatcctgtagccatacatgtatttatttattgtatgtcttgtcatttggtacatcaattcttttaacaatgtattataccctgtcattttccgcgagaaaatgaagcttaaatgctcaaatgatcacaagccaaattggtctaaaataagcaacttgactacatgtgatcgtttcttgttaggccacggactatgttccctagttatctatatgtggcgagctgtttgtgtgtactaatggtgtcctctatgcctacgtgtttaaaaaagatagggtgtataaaaaaaattaaaaaaaatctttatttttttttaaaaaaattattttttgacaatttaaaaatctttatttgaaaatagtgttctgataagttaatttttgtaatttattattaattgtttgataaattgaaagatataaaatactgaaattgaaacagaaaaaacatttaagagaaaaaaattttatttgaaagacacaatatgatggttagttattcaattgaatttaaatatttttatatcaatttctaaatattgtatagatgtacttttttttctttttaaaaaaatatttaaatatttaaaaaatattttacaaaaatcaaaataaatccgctacgatggatctagtggtggaggattcagtagtatgtacaaagttataagttttaactttgtagctatagttttaaaaataataataataattcaaatcgaagtgtgaggtatatcaaatataggtactaataagaaccaaagacacgtccaaatttcgtgaaaaaatataaactttttaactaactttgcttgacgcggttgcaagctcagactagggcatatcatcttcactaggggtgctttgattttgcaatgcttgaagtcaaaacaggggaataaatcgtattacaagataaagaatgattttatattgtttggctaagagttgtttaaaacatttgtcacagttttaaaatttattatttcccaagtatatacctagtaacctagactatatctgtgggcagtcaaaaaccgaagccgagagagcccgagaccttgaagctatgtttggataccccgaagaggatgaaatataattgtattatgttttattgtttgaattgataaaatgaaaatgaaatataatgaaaactattccattatttacctttattttttcccctcaatttaaaaataataaaaaaggattgagaattttattgcatttcatcataataggcttatacaatgcaattagttattttattctattatatgttatgtcctttatggcgtttttaatagtataaccttacccaggagggagattaatattatatgtaatcatttacggtgagtattacaagcaacacaacaatgaaagcataatccacccctgcattcattttgaccttaaagctttctgtccaattgctgaagttgctccttggatatacatcaattacctgcaaatatgttgtaatttaatttcgtcagtttgtagtgtaaaaagcctttttttaggggaaaaacagtgtatttcccctttatatatatatatatatatatatatatatatatatgatctaggtttagtcatgtattagagtcaatttaaataatatttttaatatgcatatttatataaattttattgatttgcaaccaaatgcaaaggtgatgtagtattcttaagcaaaaccttaagccagttgttgacatttaccttaaaaatgttatgcaaattaagctcaagattaaaatctgcttagttagtaattctataaccacatacctctgcaatcatggtgtctcctttgtaaactttgcaggacttgtcaatgtggctcccaacaagttgaaagctgctgatatcttcattgatgttggtggccatgaacacatcaagccgcggtttcatgtcaagagggtgggatcgttgaaccccaaaaatcagatccttctcctccgagcttttgcctctatgaaccatccaccgatgccgcagtgtgatcagcttaaccttcaatgtgtcatcacactgttaatttcttattctagtgtatgtaaattttatatatcacttaaaaatttaaaccattggcaacatgggttaaggttatacaacgtttaataaaatatcacaaaaaagcttattaatagcatttatttattaaaaaataataatatttttactaagtattagaaaaaaaatattattaaaaatcacattgtgtaatagtaactatacattaattgccacgcaatagattttataacattcacttaaacagaattatgaaagaatattggtgcttttatttgcttcatgtatatagatattgatactcttgcttaattatttcacagaatatatgtgaagtatccaagtccttaaagataatctcaaaaaagaaatgagattgatactattttaaaataggaagtgatttacaataaagataatttcaaaaaaggaatcagattgatactatttaaaaatagaaagtgatttacaatgacgatcaagtatatatgtttgaggagtgtttgtgacactcttttaaatcctctttttatgattgattgaatttattgaaaatcatcaattttgataaattttattttttatttaagataaattagcagataaaaatattaattgaaaaatcaaacgtatcaaaattaattatttttgataaattttaatcaatcacaaaaatttattcaaaagaaattgcagatagagagtgtcgctaggacaatgtccaaagaagtataattcttaatttagaagcagaattttcatacatgcatgcatcgattcctatatatttttaaaataatggtatcagatgataatacttattgtatctatgcattatatatagaggttaggagaggagtttatatactttctcacgcattgtaagtataggggaaccagcagcatcacgcatgactctcttcttgcgcacgtcaaggcttgagccatcaacttgaagcaagagatcaccgttaacatctaacacctcgtatcgttggtttaagaagaatccgcggtaattcttcttcacagttatttctgttgggtaagtcacacagaagctatcctctacaacactgatcatggggaacccatgtgccacttccattggcaattctggagcactggcctccattaaaaaaatagtgcctcaaagaattaacttcagaaataagagtttatggaaagaagcttaattaattttgcttaggattttgttgtttgtaagtgcagaaaacgtacgctttatatatgagagctgaagtggttctttcacgttttggtctccttgaattatcagaacatgtagaaaagcaagataggggaccattcttttacataattaatttcatcaagtgcttgttatttattaccaaatcaaagaacttgtgtttttttttatattatttctattaggaagcctgcttattctttgttaatttcagaagttcaaaatgaccacttttcgtatttcttagtcagctcttagacctgaagatagatatataaagagtaaaataaaatttctagaaaaattatttgttgaaatctttattcaaacacgtaatttgctgaaaactttttgtataatttctttgcctccggatttgattgtagaataagaatgaataatggagagagagagagagaaaaaaagcaccactttattacccttgtacgttttagactttttgagacaatgaatatacataaatatgatttttttttatagatataaatatgagttaaaattttaatgtaatatataaaacgagaaatgatacacaaataattttttaattttaaatatctcaccaataattttttatttatttctctttctgtaacgttacaaattaatcttatcatatttatatttttatcttattttatttctttttctagttgttaataaattaataggtgtccatcaaacatttttcatataaaatcattcaaagaagaaagtcaacaagaagttatagtagccgtaaatatgtatattttacaggcaatctggtgaatgttctaaggatgataaccatagtactttgttaaagaatgatgatgaatgagtacaacggagcactttttccctgtgcttttcaatccttatcttcacctcaagatctagccctgtcaaattagataagttcaatcacaccaataagaaggaaaagtagccaagccattctgttgaaaatttcaggctatacagtatttttctatatataccaaaaaacaaagcaggaacattagaattaccgaaaatctagcagtctgagaggcagcaaaagaaatcttttcgatgggttgagtgctgatattatccctccatttctttctatccttttgccatctttaccattctcttacctcaatggccatgcttcagtgcaactgtttctcgaattcaaagacaacggttttcagcaactacacggtataatatgtagagcagtagaggtacgaggttacgtacataatacagaggagaaccatgttgccgggctctactacatgggcctcaaaataagcccatcataaaatgattgaccggcctgattggtccttcttcagaatagacataagacgtccttgttcacttcaacggtaaaagaacccaaataatacaaattaaataaaaaattacacatttggggtcgttttgaaacaatttaccaatctggggcaggggaaaccgcccagaattgggcggcactggagccgcccaaaaccaggcggctcccagggggtagaaccgcctggttttgggcggctccagtgccgcccaattctgggcggtttcccctctttataaaccccaaattttcacttttcacttacattttcactatttcagcttcactctaaaagctctgacttctctctaaaagctctgccttctctctaaaagctctgtcttctcttctctctaaagattttgcgttggattttgaggcgatttatctcagtatcgaatctctgccaacgagtaagttaatttattaatatattttatttaattttttattatgtgtttaatttaattatttaactgtttattatgtgtttaatttaattatttaattgtttattatgtatttaatttaattatttattttgttgatttgtaaatttgttagagccatgttatttatttgatgttgtagaaaaacgttagtttataggttataggatttagtttaatttacggtttagtggtaaagtataataagataaggcttaagtagaaatgcgttaaacttcaataattttaggtttataggattgtagaaaatccgcaaccctaagaatcagcaacagtatagaaaaatgtttaaatttataggaatctgttggaggtggaaatgacgtgtgggcatgcgataatctgaatttggatgatgaataattagaatcgttgatcgctggttgagagtctaagagttggtgggtagggagtgtgcagaacaatactcgcgaaatggtgttgctatgcaattcggaatgaatcaggatatttgctggtatgtgctagaccattacaatgagaatccttgggtaagttatagtcagccagtaatggatacaaatttgtacttgaaaattagcaatagttatattaaactgacatatgaatttatattaactccctgagaaatctcagcgatcaaatataaattaatatgtcagtttaatataactattgctaatttccaagtacaaatttgtatccattactggctgactataacttacccaaggattctcattgtaatggtctagcacatacaagcaaatatcctgattcattccgaattgcatagcaacaccatttcgcgagtattgttctgcacactccctacccaccaactcttagactctcaaccagcgatcaacgattctaattcttcatcatccaaattcagattatcgcatgcccacacgtcatttccacctccaacagtatagcaaccttagattattggttatacgtttcatattagttttgtgtttatcggtaaagtacaacaatttaatttttgtaggatttatttttgaaataaatttttttgaataaatataagtaattagctttagggtttatgtaatttatttgtattgtaatttaattacaatgcatgaaattgttaattataaaaaaatttacatatattaaaatagtctgatagatggctgattcatcgtctccagcgtcttcacggtctacgtccgatgacgagggtaacatgttggatccgacgacctatgttgtaccttccccgtataaatggggtgttttactgaggcgtatccagagaacccatatttcacaggctgtgtggaacgaggacagatgtcgtgtgctaaagacgcgacgcggtaagatttcagggggcccagactgcgacgatcttcctggaatcgtttcggcgatgttagggcaggcaggattcctacatgtcgcacgcatgcgacatattcaggtataaattgtgtaattgaagaatattacagataatgtaattcctaaacattttttttatttatatcgttacatacgcattaattcttttaaacttgacttcagatcgatcctgcactgattagtgctctggttgagcgatggagaccagagacacatacgttccacatgccgcatggcgagatgaccatcacgttggaagacgtggctggtatattaggtttaggtagtgatggcgatgtcgtcactggagtcacggctgacgactggccaaccatcactacgcaggtatttggtcatcctcccctggagcgtgaggtcaaaggaggatacctgcgactgtcctattttgataggaattatgcgcaatgggctgaggtgggcggggagttggtagaagtcactaggtttacgaaggcgcacatcgcgcgtatgatcggagcatggcttctagcggacagatctggcggaagcactattgcctttcgctatatccctttgctggcaggagagatgacagatattgccaggtttagctggggatcagccgtcctcgcacatttgtttagacaaatgtgcgagtgtactgatccagataagggtgacattggtgggtgtcacgtgcttttgcagatatgggcgtggctcagattcccacccattgctccacctatacctcagcctactcaccaggagtggcattacggccacaggtatgtgtcattatccccttttattaattaggttacgagtcttatcagtattctaatgtcattcattttaaaattaggtttaatgctttagggaagtttcatccacacgaccttccctagtatcgggttacgttagattcccttgctcgggatgaggtatgtattgttatttacctaatttttggtcggttaagttggataatctgcatttgttttaatcatcgttgtttcgtaattgtgtgttaaattgttttgttcaggtggtatggcaaccctatgcaggctatcacttccttggtgctactgagcaggagcggctgttgtggatggctacgactcccattatatgcttccacacagttgagtattgtcagcctgaccgatgcatgcggcaatttggaagggatcagccaatcccccgaaggccaaggaagttgaagggcgtccacgacctatccctgcgagggaaacagatggataattgggctcgcaagctcagaccgtttatccgtcgttggggtaggaggcaccagcacatagagcttcccccccatctgactgggttcttgtcaccaaaccatgagtacatggtttggtacagggagaatgggaaacgacacattacgaagatggctgcgaagatggggcgtggtgtaagtgttgtgtaaattaaatttgtaaactaattttcattttcctggcgttattgtatggactaatgaattttttgtgtaatttgtagtttgatggacttgagacattgtactgtgccagtggtgggcagcagtggccgggattcagcatggactacttgcatgaagaagtgggtcgcattatgtccatgtttcgacagagctgtcggttggaagagcctggcccacaggtatatttggaggttccccgcgggcgtcgtgagggacatggactagagcatcgtcggaaagtgatacaccatgttcccgagcctataggagctcccatgcctcgcgttgagggttgtttcaggcctccgtggataggacccacatatggtagtcaacctttctactaccaatcgtcttatcagccagacacggggtatcaggggtttactagccagggtgacatggctacaccgccagagtggcaatcacagcatgtgtattgcgcgactactttcgccatggcattccaggggtgtgggactagcagtgatgttcctagtgggggatggactgaagaggagcttcagaccctcattgactgcactccaagcggttgtggagacgtaccagcagatccacattatgccaccccacctcctgattatccttacccagcatcgcaggagcagatgacggcatggccacctgtatatgcaggcccctctcaggcagcctcttcgcatgcaggcccctctcaggcagcctcttcgcatgcaggcccttctcaggcagcccatcctcagccagaccctactcagccacaatcttctcgacgacgtggtagacgggtgttgcccgatcgtcaagcgcgtcattatcagtggccacctgagtcgtagtgtggttttttatttatatttgtgtttatatttattttgttgcttgtactggactttattgagacatgtataacagtttaacagctttatgcacaacctggaccattttgtatttggttaacttttttactttattatgcaatttaacgctcacccttagagacttaagaaaaataaaaaacgtatcggcagataacatgcaacaaatacggcgtgactgaacacgccgaacaaatagaggcgtcaccagacacgccctaggttaggcgggacacaaaagggggtcacgccaacatttgggcgtcaccagacacgccctaggttaggcgggacacaaaagggggtcacgccaacatttgggcgtcactgacccttatataagggtgaccatccacaactcgtcgatatcaataatatggcatttctaggagaaacaagcagtcagaccatagctaattcaacattagccttcatttttccaaatggatcgatgaaacacaacgacacaggtgtttattttgagtgtccctctccaataccaatgcgggttcctgatcattgttcttttcaaacactgaagactaggatgtgcgacacccttatgctaagccgtgaccattttctggacgaaatctactatagaaagccaactgtacgtgcaggtcagcaatgtttttatcattctgttaaagttaccaatgataatgatgtttgccaaatgttaacgtgcaatgaacaaatgtcgagcgttggccctatagaaatactgtgcagcatcaacagaacacctgacggtatactcagcctacttgaatccacaatcgtcccaacacatgatgcagtgctatattacaacggcaagtggaacatcccacggcaaggcgattttgtgggatatgcattcaccggaacaaatccaatcagatttgacattctttcaggatgcaacattgaaacactgaaggatctaatcaagcaagttgtgcctgtcggccttcctccttatggaattcacaactcacaggtggtaagaaaattgttttttagacagccaacccattacgcttattcaaacaacacaatcgaatatcacataaaagagttgataaccgatgcagacgtgttgaaggtcttagctgaatccaactattggaagcgtttttgtccaatacacattttagctatttttagcaagcccgttgcccaaatggaagaagacatgtctgctacacaacatatgtgaaactgctaactaatgttgttattttcgtatggcgttattgttattgttagtgttattttccattttggtaaacactgtttattaagtgtggttaggccgtgtggttattttaattgttgttgttaactcaagtgatgtcgttattgtatttttcagttgacaaataatgaaaggctcaaaagttgtaaaacacatgtgcaattcgttacaatgaaatacattaacatccaagtacttaagcaaacatcataaaaaaatcatgaaacagcacgacgatccggacaagctctccgattatgtccaacagccttgcaaattccacatctgctgcgtctttgactggtttcgacttcgtccatctcgttccgaattttggtcgcctttggacgaccctttccacgcaacatttccctgtcgggtatgacaactggaccgtcactcagtggaatagcaccttcattaccaattggttgccacggaaatgagtaggcgtgcaccaaattacttatgaggaacacatcatccacgtactgaaaaggattctgacgcacatgtaaagcagcagctgcggcgtgactacatgggtatttgaaggccttaaacttgccacattagcaaaaatgctctccaaggttaactgaatatgtggtctcgcagccctcaaacacctcaaattgtgttcgttcaagattatatgtgcggacgtggtggcctgtagcaacggtctggttatgcctcatagcatccatcacatttttgcaatatggcgtggaaggatcaacttgtgaaagagccgcctgacccctagtcacaaaatattcaaccaatctgctgtacgtgtgcttcaccagagcagtgataggcatgtttcttgctcctttcgacaccctgttgactgattcggacaagttagtggtcatatggccaaatcgcctcccctctacatcatatgcacgtgtccacttctccttcgggatgctatcaatccattttgcaacctcagggctgctatcacgaaatcgtgctaacgccacgtcgaattgaatcatacagggtgtataacctgcaaaacaatcaccccattaacaataatctacttacggatatatccatttaatatattcacaaaattgttaatcatacctaaattcatcagcgtcttcttcaaccgttgatttctgaacttttgattaaaattactggcaatatgacgaagacaaaacacgtgatgagcatgaggtggttgccaacctggatgattcgccacagcagacagtatgcttcggtgcctatctgaaatcagacaaatgttttgcctttgagtaacatgcaaacgaatgttagccagaaagtatgaccaggcttccaatgtctccccgtcaactatggcaaatgctagtggcaaacattcgttgttgccatcctgcgtcgtcgcaatcaacaatttccctgtatacttcccatacaaatgagtgccatcaatctgaatcattggtttgcaaaaattaaatgcctcacaacactgtctgaaagtccagaacatgcgatgaaacacacgttttcctcgtacgagtcgatttgccacaaaataatctttggtttgaatatcataaaaagaacctggtgaaaaacgaagcatgtagccacaccaccggggcaaatatgcatatgattcttcccaattcccataaaccattgccactgctttctgcttcgcaaaccaggccttacgatatgaaactctaaatccaaatgaatgggtgatcctttcctgaaccaatgcaatcgacacagacggctcctccctgatcattcctaacaatgcaaatgtaacattcacggcaaaattaacaacattaaagaaccattatttaactcatatacaggaaattttaaaaatacttacctactacaattgatgcaataacatcagcatcaagctgtctatgaccctgtgaaatatggtcattcaggcaattgtggttgccaccccatcttgaaacagttcacttctcaccgaacgccggtttaattatcctaaccctccatgggcaaccctcgttatgtgcaacacacctcatggtaaacttgttaggcttgctctcaaccacatatgcttcttgatgctccttcatcaggttccgcttacatgcgatttgtgcgtcctttttgaaggcaaattcttgtttaacaaacaacggatcccctaatttccatggaccctgaactgaaccggaacaggaaccggtaaaagattcctcttcgcttggatgactccaatcaatgtatgtgtagtgaggaattctatcctaaaaaggagtcacctcagcaccttcaaataccaaatcaattgaataaacataacatgcacactaaaataatataacatacaaatatataaatgattttagtcatcttacataccttcaacaggttcttgtgattgtctacctcctacgtccggatggtgatggatttcagacgaccccgcagcagtgcctgcttggaattcagtcgcatccacaccgacatcgtcatcattatctgacgcactagcatcctcttcaagaagatgatcttccatggcaatgttgtcatcatcgtcatcctcttcgtcatcatccataacccaggttgggtcatgtgaatcttcctcagacacatttacagatggagcagcacatgacgcagccacatttgcaactggagcagcatatgacgatctacgcctactaggattaaaaggaactgacctaatgggtaaaacatcatctgccacagtatagtccacgtacaactctaaaaaatctttcgttgtcaacttaagaaattccactattagcaactctacgtcttcgtcgtccgcaacttcaaaacccatgtacttttcacgttgccataatcttcccgtaatacgtgtgatacattggttgtcttgcagacgtaatttttggcgtatcttcacatgtacatcaccgattgtcgagcttcgcttcaaaagtgtctgctttttttccccttcaaaaacaacaccttctctcccttcaaatatccttccattataatttaacacaacacggacaaactcctcaccacctgaactcatttgtttcactcaacaaaaactacataagttgaaaaaaattatgtcagaatatgttgttaccattactcataaaccatagaccctaccccttacactatcaattttataatataaacactaacaatttcataatacaaacattaactaaaccctaaacattaagtaaattcaattgaacaacacccaacttagaaaaaccctaactcgtaaccctaattcaattgaacaaaatcgtaattcataatccctaattcgtaaccgttaaccctaaactgaagtcactaaattgacaactaaactaaatcctacaacctaacattttttcctacaacatgaaataaacatgaaataaccaatatggatctaacaaatttaaaattcaacaacataatatattaaataatactcagaagttaaataaattaacttacctgttggcagagagaggtcagacaaaagctttagagagatgtcagagaaaaaatttatagagagacagaaggcgcgttggttatgtctgaaaaacgcaaaacggaaggattatatggaggggaaaccgccagaattgggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccccctgggagccgcctggttttgggcggctccagtgccgcccaattctgggcggtttcccctgccccagattggtaaatagtttgaaaacggccccaaatgcgtaattttttatttaatttgtattatttgggttcttttgcctcacttcaactgtaaaagtgccactcgagttacattagtagcctaattatcacaagaaaataatggttaaaatgtgtttttttttccaaaaaaaaaaaattaaaatgttaggatttcattcttgcaaaaaaattagtatatttttttgtcttcaaaaaattgaactataacaaattttaattcagaattaggttatatatctaaacttatatcttgtaatttgtgaccattttttttttttgcaatttaagactataggaattttttgattaaaaactgtaataaatgtaaatgaaatgtataatctatttttttcatatataatatgaatctcattttatgaagaatttgtaatcataacttgtatgtatatataagtagtgttatttcaactttgatgtctcccataattctaataagtctttatctcttaactcacctattattattattattattattattattattattattattattattataataatagactagatactattatctttttttatatttttatctactagatataattagtattatctattccatgcaatgcataatgcataatgccggggtgtactactactatagtatatatgtactgaatctattgtaacctcacactcacctggcactccctatagactcgtggttttcaaattaggagtgatgtccttttcaatatatttgttttttatcctcttctctacaaatggttgagttgtgactgttcttcttcccagtgcccgatgactagaacccttgttcctgtgggggctgactgcatcaatcgctaccaaatcacagatatatatgaaaaacacaaataatgtaacaatttctgccactccaaatactatatccgcaaattcacaaatagacacaaacagttgaaaatataaaaatcaaatcaaatcaaatcaaatatatatatatatatatatatgtatactgctaaaatgttatttatatatatatatatatatatatatatatatatatatactgctaaaatgtctctcttcgaaaagacctgataagcacaagtgtttctcgctctctgcccttttgaggcatttcattgtttgctgtggtggattttgcagccttgtgaagaagaagctctcgagttcggacaaacgacacctcacaagtcacaacactgtatatcttgcttaatcattcatgtcttattctcacattttactattatgaatgttttttttatcaaaccatttttttgttattcagatcacattcttctttatatatggcagaagtacctttatacttcaaataataaatctgtcgtatgaaaaaaaaaaaaaaaaaactgtaacagtaaatttatttcatctgtatcgaatgttttccactctccaaattcaaaaacaacgtggaagagataatttttcttttttggtaatggatactaatgcagcaagtccaacctttgcgggtcaaaagacccaccagatcagattgtttcctataatgaaaagaatgaaggtgctggtcagatcgacgaacaagtcatgtttctccaaaggtattattgttctatcaatattcaaattagtatatgaactggtgtctatagaagagtgataataagtagcaagagaatctccatgatgatgtaggagactatttttatagaaatcaaataaatatgaatgagtcacaacctacctacaagctgtagcctcaaaatgcagagataagaatggctagcgcttctcatatggtgtactatattggatgcatttaacttattcacttttggtcctataattttaagattgtataattttagtccaaattttattgtatatttgatcttctaaatttctaaaatttgacaatttagtttattgttagtgtatcataaacttgtttaacaaaaattgctgatataacactaacacgttaacataaaaaatagcatgacagtctaacaaatatatgatactattacttaaagtgacaataactgttcaaattgtataattgtaatattgtcagcatactattatttagtattatattgatatatgtattaatctgttaggttatttgtcatgttaaaatataagtgtcacatcatttgtaatgtgacatttaagtaattttatttaaaaaatcaacaatagtggtgaatcaaaaattttaaattttaaaaacataaaaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgatgttatatagttcttgcttcgtatatataatcgtattttatcattttacatggcaatgtctttttatttgttgaaacgtctgttaattgcaatttgtctactatagctataaaagagaagaactaatgagccttaattaatttatacaagtaaaaataaaatacaaaacttgacttatttgattaaaatttaaatttgaggcataatgcatttaaaagtataaaatttgaactcggattatttgatttgtttacaatttaatgatttttttttcttttatcaaatccctttttcaaattttcccctcatgttagttaaggtagtatgcaatagatgttttatataagtaaacttaaagaaaaaagacagcaaacaaatattttttaaacatagaagtgaagtatataatatattattttttctgattggtaattaaccttaatcaatatataattatgtaatatgttattttttatcattttatgtagacatatcacatagttcttaatgtcaaatttataatatttaactttaactcatttacataaatttcacaagtcaagtgtaaataattaataaatttatttatatatatcatcccaaccctcttcaaaaatgcgatttaacaaatttaattcaagttcattaaaattatgataaagtattttgatactatatattaaatattatatttttaatgaatacattttatgttaatttttaattaaatttttaaggagaatacttaacaaaatcgaattaattattttattatatgttcgcgaaggtgcctttttcctatgttattggagaagcgaccaattgatatataaaatctttccaaacgtaaaggcagtaataacttggaacccagaagagcttttggcagctagccattataacagcagcaatgtgaaaatctgatactaggatcctatcaactttttaaagaaccccaagcattggaatttgcagataaagagaataataataagaaagaagaaaacaaagttgctgatttaatagtgtatattgttattaatgttcgtaggcaacaaaattatggcagagaaaggacaaaatggaatagctgtccataatgcaaagattttatctaattgcagaaattgctctgtactgaatggaacacactcacaacaacaaagcgctatgtagggtgtatctagctagcttatataactatatgtttacttgtatgaagaccagtggacagtgacccttttattctccttcagatgaaaagcctgagtctgaatcgttatcatatccaaaaaataaaaatgctaggtttggaaggggaagaaaagcaaaatgcaaggcataagagaggataagaacttgaacattgaacatgataaacaattgggtcatctaagagaaaaaagaaaaatagtatcataattatttttataatgtaaaattaatttatatatgtccttttacttttgaagaggataggtaactttctttttcttctcaaaacttgcgacagacaagttgattttaactttacccgaagttatttttatttcactttcttaattttgtttcttataaataccattagaaaagtttatattaatttattaagttgggataaataatgtgtgttatattttaattactttattttaatgtgaataaatttcaattattcaagaaagcctttttattatatatgtatcttttaacaccgtaccattagcaactaatttttattaataattttagaaatttaaataatgatataaaaattatgtttaaaatcaatagacaatatatcatacaaatatttaaatttcatttcatcttttaaaaatctataaaaagaagctatgtttagttatctttcagagtcgtaatacacattacttacaagagagaaaacacgaaaaatattcagactgaatggctcgatccgtggaataggtcaccttgactaaatcagaaagtattgatcgaggactcatcagttcccacatatttatcaaaaggttattttaatggttcatattcccatgaaaaattaaacatacatgagactgtttaaaattaacttcaggcttatcgaaagttgttgggagcggtcctacatatgcaagtctcattcgtaattattaattcattatcactaaaatattcctttatattaaaatagactaatataatcttgcagatttcacctcttaaaaaaaataatatgactcttagaaattaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatgggtgtacacgagtcaagtttgattaaatttgggaaaattttatacttagtcaaaatacttaatttaaattgaattgattggatttatgtatatatttttttaaaacttgaaccaattcagcttgatcaataatgagtttagttacgttaggtatgttgaatccaaagttccagattttctttaaaaaataaataataatttcttaaaaaatattacaccaataggttaggtcatcaattcaaatgtttaaaaataaaattcattatccaaactaaaaatgatcaaatttgaacagttctaattggatttaaacttgaacaatgactatacttaaatcaatgtgtttggattgggacagatcgagtttaacttattacaatcttacccgaacctgtgaacaaacaccctttgcccccaaactcgttacctcatgtttgtagatacgtacgtatatatacaataaaatgtttggctttcttgtttatattatcttgacagattcttgcattgtggccaatgctacatgattctcttacctgtccatgaacaacaaaaacacttgtctttcaactttataattttaataagttttgtttgcattgtcacacattggcatgtgaatgtacttttccaaagtgcaactcacgtgagttttgctatctcgcaagtaacaaaaatcatagcatactaatgtacgatattacaaacgcaaaatagttcaggataagaagagaaaataactagcttacggaaaattaaactcatggatattataattttaataagttttgtttccattgtcacacattggcatgtgaatgtacttttccatatataattacaataataataaaaatagataaatattggcatgcaggtataagttaattcattttatccttcggattatatatgcagatctaccgtataggcgtatagccagttagataaaatggaggctctgtgaaatgtgtgaatctgctatcggtttcattttcataaatagagacaaacatttcagattcattttttaaataatttggaatgtcacgagaaacttttctgaattgagcaatagagttctctgcataattggaccctgaaaaatgtttctgtttttggtttcattctggtctcatttggtcacatgatattatactaatggacaccaaaacgcgtacaggtcagcaacatatacaatattgacattactcgcattcatcatatcatttactaattttaaataatttacgaaataatagcatcactttaatctatgcaattaagcagcatgatatagtaatcattcggcatattatatacatagttgcatgactccaatcatacaaaaagcctaccgtacatatcatattcatcgatcatgaaacatgcgtaagtaaaaacattcaaatccaaattaaacaaaatcttctcagtctccaactttattgcaactaacaactcttccaagtctccaactttattgcaactaacaactcttccaagtctccaaggacactccagctataaagggcttaggctccactattaacaagaaatatgaagttagagcaggataacgcaacggagtgcatttattttctttcattcttaattaaaaacacagagtacaaattcaatgtgatccgtaaacaaacttaatcaatgataaccacttgtaaatcatctggataagttgttgcaacatataattatgctaaatatttatcagtctttttttggtgatcatgcatgatttccgccattagtattatattcttattcgttttgaatataattgccttagtgtaaagaaaaccctaaatcaataatcttgcccgtgtacctcacctggctcaccaagcaccatgcagtttttgtgcagtttaattggcatcaatattaattacttactcaattattggtttttgaatcaaagccaattaattattttagttgaaatgaaatgctaataattaagggggtgtgtgtgtatacgttggaaaaatatagaaaaaacgtgaggttagagaacttaatcaggatttgtaaatactcaataatattttaattttaactatttatttaaattatatgattaaggttagtaaatgtttatgaaaaatttgctaatatactagcacttctttttttaaaagtaccttaacaagttataattacgattttcttataatatattaaaagtgaaactagataataaatatcttatatatatatatatatatatatatatatatattaaatgttattataacaagccactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtataattttgtttttttttttgccacatatgtacgatacatttaaatcaaatagatgataatgacctagctagtctcgatcgatcccacgcccaaccaagtcttgttctttattgtcaatttttcaatgatgtgccagtcagtacacatatttacctttgctttttaacttgaacttcaatgtttggaattgactagcataaccttttgttagcatgtgttttttatgaggctgctatatgtctcattcaattaatgcataaacataatgtgttttatattttaattaaataaatgcataacaaatattaatcatgcatgataaagactttaactttcaggcatattgataatataaaatttgtacactggtttttttccacagcaaagcaattattattattatagattaagaagactgaattttcacaaggagtggcaaattattcaatcacaacattatacagagaacagtcccgtgagtgaccaatttgtacattgttaattaactaattagaattcaccttaaatatgattttaaaatggttattttaaagctcaataattttattatgtatgataatttattattagatgataatgtaatttttacataactaagttaaaattaattatataacatatagttagtctaggttaaattgaacttaaatctcttatatatatatatatatatataatatatagttttagggtttgaattttgtagatagaaataaaatttttggaaaaaagatcctactaaaaatgatgaatctaatttttcaatggaaataattataaatgccttaaattcacaaattttcctttttgcttcatctctctccccatgaattctagcatcggatttcaattgaatctgaaacgtaatagaccttcaagatgaaataactaatggatgtcttccctttgggacaatagggaaacttcgataaataaaaaaaaaaaaaaaatccatcagagaaaactaccctcgtgatcttgctgttttatatcttaaagttgaggtttattatataaaaaagtactaacagataaaaacatttatttaagtgttaaatttgtttttattggttaataaaaaaataaaatattaatatataaatatacattgtgaatttatattaacaatatgatgtataatactaatatttgatgtattaataagatatactcatatactaatagaattccctgtttgtatcaagtacaattctgttaatataaagtcttaaatctcaatatcaacagtttaatttttatcaaacaaagactatatattttgaagtcatataaaaaagactatcatatatatagaagttaattaatctaattttaaattgtgaacatataattcttttagtgattgtggcttttaattaattaatctgcaaatcatgattggaaaaaaaatactattgttattgcgtgatagattaataaaagacagaagaatctagatagataaatgaattatacaataaacgaaggttggtcaggaaggagtatgatccatatatatgggtccaacaaagcattgtgctcgaggttgtggagggaaaattgggggtcacaggggaaaactagcaactagccgagcacactaatggaatctaaaaggctcgaggagagttcagagcaacaaaaatacttttatggaaggcaagagacaaggtaggagcagggatatgtgtatggaggatattgttttgttgtgatgattaatgggcacgcatgtgaatggaggtgggtacgtgatttgtccttgtggaatggtgacaatactggaacacggaagcaacaagaacccaacagctctaaatacatatcatatcatatgatccttgtcattaatatcatatgtttatatctctcggctggtatataagctcattataattaaatacactcatcaaatcatgtgttgaagaatatcttgaattaattaaaatcctatgttctttgttattaagtttgtgttagggtaatacaagtaaaagtgacgagtgaaaaatgatcatgagccaaattattattaacattttaatgtcaaatgcgatcatatcacagttttatttagaactatataataagtgtgtttaaacgaaaataatactaagttggatgagggggccgggttaggataattttccataagattctaggttcaagatttattattatcattatacaaaagaaaaagaaatagtagcattctgatgtttggatatgcaggtatatcagtctctttcatgcctttccatcaactcttttcatttctattacttgtacctaacaccatagatagttacaattatgaatgtctttgttttcagcggaacaaaatctttgagcttggaagcacggggaaaaccacaaacaactatgaacttcaaagattaaaaaagaaatgctaatttatatgttgttacggttaaaagaaaaattatgctcagggtagagtcccctcccatttttttcccttttgtttggatatctcatacctttcttataaaaaacaaatccgttgtgaaattaataatgaagtttgtccttcctttccagcaatgcatttctgtctacttgaattattgacaatttgacattatagagactcctaattaacagcttaactcaacacaggcagggcaaattagtagcttgtggtggtttagtccatgtgattgacaaaaaaatgatataattttccgaaatacatttggcaattgttagattaatactggatctaattaataagaacatgatcatggatttatgtctaactatttttttataggtaaaaggaatttattgatagagaacaacaggtactctaaccacatacgaaaaagcttttgtactaaaaacacagagaaatacaagcaattggattatgcaccaatcaagaaaagataaaagtttgctacctagattagattgaaccaagaccacgagtgaaagttaatcaatgggtcatgaatttatgttaaagttaaatgcacttatatatctttttcaaacggctgtataattagtctttttgtggtattaagaattttttattattagaaaaaaattattataaaagaagtacaagaggtattccaatacttatatacaagaaatccaaaacatcttcatttatagtctagttctttaataggctttctatacatgcatacatgacaaagggtagaaggaccaatcttacaagacatacatctactttagaaattatctaagtctaagccaatgagtacaatttaataatatctacagttaaaagtaagttcattacggtgtaaacaaattaactagagatcttgcaaattaagtcaccgtccatttttttcccttcaatttattcctcttaatcaaactcctatgctgaatcaagtgagaactaaatccaacggttacactatagagaaatcacgtcatgcatcaaagctattaaattccaatcagctttgttaagtggttaaaatttcctttatactctctttaattttattcacttatgtaaaaacttgactcgtgcgtgttaacaattataagacttgagtttataacattcaaattatttcacttaattaatgggacctgttacttatacatagtgtacacgtaagttgtctagttaaacagtaaacgtgactcttgggttatatctttacaaaatcaagaaatttagatcagaatcagatgcctttttcaatgaagaaaagaaattaataataaactattagtatgatatccgctgagcgtttctttattggacaagctaataattgcaacgaggtaaaagtggatgcagtaatttcagtgtccgtgatttgaataccacagttcaagttatatatacagaaattaatccatatcatcatgtgaacatccatgtcgaatttatgtacagcttttggatatatatggaagctagacaagagataattatgtatgaaaattgatgcggtttcaaagctaataatggattctaatatgtttattggcactgcatggaacctccagctagcaagaatacatgttataatcgtaacatatgtacgaaacaaaagcatataaatcagcattttaatttcactttcaagcgggaaaagagagagagaaaaaaatgaaaatcagctttaggtgtctcatatacgatgagaagggtgtgatggcacgtgtggagagagaaggagaaagaagacaaaagtttgattgctggttcgagaaaggatcgagagtggaggagagcctaaaaagcccccgtgaggagtgtttggaggcattccaaaatcacaactaaacatccttttgttgcttctccttcacttctttcgatggccaattttcactatcacgagttgatgattccccttctcccattttttcttccaactcaaaaacttatgccaaatattacattttttccaatatacccttgtgctgttcatagctaaatataattatatttccttagtttaaaaactaagcggcacttcctattttcctggcatacagctatatatataaattaattacaaactatatatataattgttcctgtaaaactaaaataattaaattagatgttctcatgacttgagtttgaatttaaaattctgttgatttattatttattatttcattataactctttcataaggtaatgcatatcactcaacatattattttgggaaagtttagtattaagaaaatgatcatttttttaaaaaatttgtttcagaagttgacagaaattattattgttttaaaacatgataaactaacacccttaatttttaaataaataaataaaaaagaagccaattcaatgatctagtatactgctattagatatgtattatattaatgaaattccataatcttctagctgcaccacatcaataatcaataagttaacacttggcaaagagaaagaagcatttcaaaattgggcaaatggaaagactccaaaatatataaaaagggtacttttgtaaaaccaaaatgtatatagtatttatttatgaataaactgagacggtcatgtgggaagaaaacacatgagatcatatggatttgagagctcatcccttcttttaaatgaccacagaactctgcagagttgatagcaaaagaaaagcaccagagagaaagaaagccagaagaaggaacataagaggagagagagaaagagagagcacacaaaatggtttccaaagagcaaaagagagcagcactgcatgagaagctgcaacatcttcgttctattactaactctcatgctgtaattccctgcattatctcctctgatatctttctttccattggatttctccgtgaatattctcaatgaaataagccaattgcctaaaagaatgttcagttagacagtaatattgttatacagttatatatactcccctctgctattcaattcctcttccgaatttgattccatttttgttaaaggaaacaatcttccttgctatttttcttattattcaaatcttacatagtcatatatataattttctttatccctattgaccaaatccatattcattctttttgcatctatgattatctatctatgctctcatttccatatatatctgggtagaaaactgaagcacatagaaataaaatgatttatgatgaatattaattattccaatgtaatatcattgaaaatagtgatggacaactttctttaatttaatatcatttgtcttgtaaaccaacgcatatatatatagttgtttcctatcaattatatgcagcttattgagatagtaaactatctgatcatcatcatcatcatcatcatcatcatcatcatcatcatcatcatcatcatcatcatcatcatcatcatcatcatcatcatcatcatcatcatcatcatcatcatcatcatcattattattattattattattattattattattattattattattattattattattattatatgaatggttgatggcagctaaataaaacctcgatcatagtcgatgcatcaaagtatatcgaaaagttaaagcaaaaggtagaaagactgaatcaagagatagcctcagcagaaacttcaagtgtcaacaaccctttgcctatggtattttcttaattgagaaaagttaacagcatcatctatattcaacaactccagtacatatatgtttgatcaagttccttgcaatataaaaacattgattggagtggcatttttgctgaatggacttgtgcaggttacagtagaaaccctagaaaagggatttcttataaatgttttctcgggaaatgggtgttccggtctgcttgtttccatattggaggcctttgaagagatgagactcactgtacttgaagctagggtttcttgtacagacacttttcgatttcaagcagttggagaagtaagatatacacatacatagcaaagaaaaactattacaattgcttatttattttcaacatgtgtatcattgatctctctcaatactttaggatgtcgcatgtgttgtccttttataaaacgttccttattgggggacgccagtaaagggacatagttactgtgtgcattaattgatggtcatgcatagacagtgttaaattaatcttaaccttaacaataatagagtgttcattaattgtctaccacatacaatgtctttcagtaacgaattaatattatacattttcttgcatttttctccaatgtatattcatgtatataagaatgacggcaaaatatgaatgtaacttttgtagaatgaagaacaagcggagacaattgatgcacatgctgtgaaacaagctgtggtacaagcaataaagaattggagcaaaagtggcgatcaagaagagtaaatcagtatatattaaaaattggaagctatcttgtacgacgcttgattcctcaaggaacaatttgccagttagccaacatgaagcaaaatgggataagaaaaaaaatggaaaatgatatatatatatatatatatatatatatatatatataatgccagctataagagaatgataaagagtagttgatggttgatcaaatttatgtatggagccagcatatacatatctaatataatacccacatatatacatgttacggaaattggatcggataaagcaaaatatgagatggagaaaaaataaaatggggagtaaaatggaacacagacaagacacaagtatttaacgtggttcggcaatatgcctacgtccacgggcgaagacagatcaagagttccactaaaatgaagaagagtacaaaaaaggaaaaataacactcaaaacccaaatcccaaatacacccaataatcctcacaaggatatcacacaaaattgggtacaaaagaaaaaatacagaaatgggtattttttctcacttgatgtttactctcacacactcctaatttttccttcttcttcagttgcttctcttctccataaaccgtttgttacgctcctttatataggggttgcaaaggaagtaacccgtgagctactgtgcgtgatttgaagcaaatttcaacatttgttgctgtgctttcggtgcatttaaagctattactgcgccttcattgaaaaaatagcatgtactgcgcgttcaacaatttctgcgcttacaacaatacatataatgatgcataaacaaatgaatatataatgcattttttaatatatatatatatatatatatgaggtgtcgaaaattataattaggttaattaacctcacgatgtaatgaatgaatgaatgattagttatgagtttaattttcttcaaatcatgccaagattagttccctggacaatgttcttaaggtcaaaagtaaaatgaaatgaggctaaccagatgagacacgtaaaacttgaaatggcacctccctaacggagtttagtacaaagaaaggtaacaaagatgttgcctactgaaacttcaagcaatgaaagttgacacctcttacacatggaatacacaagtgatgaatgttttcaagttaatcatgaaccgaagacacgtgatctcacggtcgctcaggagctgcaccatcctttaggcttcaggttataaaaatggtctttgcatggtaaacaaccgaacgtataaatttgtaaataaagtatattgggcctttattctttacaatgggcacatatgttcttctacagcgccctttggactcttgaacattatatacataatggggtacgcttttgaaagtatacactatacaatttttggatgatttaattaagttttaacttcctaaattttttcaaaatttagtttgtattttttaaacttttgtttcattaattaagatttttaaattttttattaaaatttttagttcctcaatttttgtttgacagatcaaagtcctaaatttttaaaaatttcaatttttagtttctcaacaaaaattttaacatattatttttatttatttaatgagattttaaggaataaaaattaattttttttaaaagtttaggactaaaaatcttaatggaaaaaatttgagggacattgaccagtcaaacaaaagtttaggaactaaaaatcttaatagaaaaaaagttaagagaccttgatcagtcaaacaaaagtttagggactaaaaattgaattttaaaaaaatttagggactaaaaacttagttaaccctttcaagattgtatgagttatgtacatgtaaaaaaataaactcttaatgacttacccttaattgtttcttgactctaacgaaagaaaaaaaatgcattaatatgggttcaagacttcaagttttgatcgcacattattacatatatgacctttaacaacattttttgtctgatacttaataaaaatgttgctaaaacctttgacaacatttaaaatatattgtcaaatataaataaatattactaatatgctttcacgatattttatcaaatgttgtgtatagtacatgttgttaaaacctttaggttggggtttaggtttggatcgggtcaaagtggtttgggtttgagtcggagtgggaggaataggagtttgggttggggtcgaagtggaggaaagacattttgggtttgggttagagtaaagggaagagggtcggggtctatagtggtttgggtttagttctaggttggagtaaagggaggtgaggtttgggtcgaagtggaaggaggagggggttgggtttaggtttgggcaggggtggagggaggacaagtttgggtcagggtggagggagaaggtgttgttggtgcatgtaagtcacaaggagactaggagttgaacctggacttgaatttttgttgacgtatacttccactccaagtgcatgtactcctagtcacacttaagagtttgttttcgatatcatccacattaggcgtatcaataatgatagaatctagattagttagggagtggttgcaaatggtcgtataaattttcaaggattaaatttttcaagtacacaaaaacacatgaatgtccattaggcagatacctaagccaatctatgaaacccttaattcaccttaaaaatcgcataagccactatatcagggtaatcaaggtctttctcatattgtaaattgaatgacacattgcaaagatactgaaaagtaccctaaaactttgtggtgcaagggtttattgttaggacatatgatatttttcaaggcatcaatatccctacgcaggtgatatgtaaaatatgtttgcaaaaggcaagtgtaccctacacaaaaatattgtggactcgatagtctagatatcgtgccctagagactagttgtattcttaaataattcgatttgtataaactaaataattttggaatagaaatattacaattagaagcccacaaaatattactcacattctttttccaatccaaaagagttcaatttttgtacacaaagcaaaaggacaccactcccacttctttcccttcctatctataattaaaatgtgaaacttttgacgtggaaaggagcacgactgtgttgagcagaagcatgacaattctcgaaaaataatgacgttgatgatctttttataaaaattggagaacaaccatcccgaggagttttgagggtgttctgaaaagagcacaatcgttctcttcattaaagcgctcttctaggcatgggtgttcaggacttagcatgggtgtgttttggattcaacatgagtgtgcttttttgacccttttttctcaaccccttttatgctgaattttcgcattctatcactctcaccttatctatatcacattttaataaaatcccgtgagttttgcaaataaaatgcattaaagcaacaccaaaacttatgtataaaaccacacaattaccagtttattagcagggtcaatcctgagatttttggtgtcctagataaatcaaaaaaattagatcctcataattattgaaattaataatgttcgccttgaaattttttgttgtagaactcattaataatccattaatagtaagattatttaaagcaacgacaacatgaataattaatattattctaaaattcgttattaacaataacatgactagttaatcgatacaaaatcatttaaagcaaaacaaaattatttaatctactttgtgacatactatattgcaaataaaattttaacatattcacttattcttttgattttaaccctccagtttatcaagggaaagatactctttttaatccggagtttggccaggagataagtaaaacctagccaataattattcctgtcaaggatcgaattcggatactatctgaatgattcaaccttaacttcattacattttcaattatgctaaaagactttatcaaaattgaaaatgttaaaattttatttgcgatatactatgtcacaaggtaaattaattaattttattttactttaaatgattttatactgattattaactattcatattatcgttactttaaataatcttgattataaatgaattattaatgagttttacaataacaaaaaaatcaagatgatttttttaataattataaatacataatttttttttattgcccatgacgtcaaagatgatcccaggatcaaacatgagaattatcatattttagagaatttttaatttttattattttctttttatgtacataatttattcctctttgcattttacaattcaaattcaattaaacagaaacaattcttcatggtcacgttattactaaattataatattatataaaaattaatatttatatagactaaataaaaaatttaataccctctaaaaataagatcctaaacggtcacccagcttgagggtgctcaggtcaggcgaaaggtagcctgtgcacaaaaaagctcaacgagttagttgaataacctgtcaggctggcccatagcccacataaatagcccctgttaagtatatagtttgcatcgaattaaaagtaagctttacttccaaataaatttatatttgtgacaaacttctatattaacaatatttgtagtgagttagttttttttagataaatatctattcgatcttaaaattatgaatcgataataaattgatatttaaaagataaagatttaaatttagttattgaatatataaatagtataatagattagctagtataataaagacacattttttttttcaaaacaaaaagaaaacctaaacaattgagtaaatgcttgaaataaatcattaaatatatccgtgtttcacatttatattttataaataaatatttttgaaatatgtcttatattattagttaaataaatatgatccaatacgaataatttatactaaaattttatttaccgataaaatattatagtttttttaattaaaacaatatcatagaaagatataaaacttttttataatatcacttgtcttttccatttcccttttacatgggctttatacaattcaatcaccgagttgatatcagaaaatagatcagtagggaaacttttttacatggactttatacaatttaatcacccagttgatatcagaaaatagatcagtaggaaaacttttctgcttcccccatatgataatattaaatataaataattaaagaaacagaaaagattacaacaagttgatgatatgatagaggaccctctcctcatctatgtggaataaaaatggctaaatatgcattatttttttaaatatttaataattttagtaaggactgaggagctcccattcaacaagctgggccacactgggagcatgactctgggcctgtggttttggctcaccagcacgattctcttagtagcgataagccacgaaatcagacaacactgccagtgttaacgctagggcatgcaatcttcaaaccaaaacaacaaaaaaataaacgaaaaataagtaataattaaattcagaggaacactattatggatgtgaatttgtgtatgtaaaattgtggatttgtgggacatgtgatgtactacctggcatggataagtctaagactaggcttcattggagaccttgcacgcgaattagccacagtccccctacaaccaacaccattgtaatttagttataatgaaatttatcaccaactataaattttgttataatagatagtagagatttcacattgattgaatattaaaaaaatattgttttgaatcagtgatatggttacaaatattgttttttcatttatggaaattacgaatgatgttaagaatatattctcaaacacattcttttaaatataatttattttattggataaaattgattggaactataaaatcagaaagaaaaattgattaaatagaacatgagacacataagagagtgtgtgttaattagagagtttttctagtgattctctatgatcaaaatagagtacgtgagggaagggggaaaacttgttagttagacataacttaccaactgtggctagcatgtgctttgaaacccaaaattgaattgcatccatgtagaatcttttgttgctcgatctcttagatatgctttagaatttaccagctaggtgggggtgatgatgagaggttgagggtgagtatttatagctaaggagatgagggtaaggttgtaatttgagattcttttatggtcccttggtttgttaatttacaggggggtttctatctgttttattatgacagtgaaaaggttaaacaggaggaggctttgttttggaagacggtgttgctttaggtgaagtgatgagccttgtggattttggtagttgtttaagatacataaagccatgattaagtgtttaatgatagatggaataaaataatatgtcggcaaaaacaatggaggataaaaaaaatatgagatacaataaagttattattgtattatgtaaatattttatgatagaattcattaagtttatattttacatatctagtttaatttattttagagagtacttttataattatctgaaagtgttttggaaaaatattttttaaaactgatttcaaataaaaagaataccaaacaaaaaggagttaacaaattaaagtaaaatataacaaactttaatttatgtcattttttactgttaaatccaaacatattataaattaaatgaatcttcacatgcatatttataatttatttttatgtaattacacatattgtgagtactgtgaatactattataaaaattaactttacacacgtattggtgttaagggtttagaatgtatgattgggtattttattagcgttaagtaaatatacgaattcttaaaaaaaaaatcaaagtaatccttcgggaaaaagataatcaaaatttaattaaaagataaataaagtttgactaaaaattatttttattaataatcaaatttaaatattattttaatatttaattttaacttcaatatattgaatcatttgattcattataaaaatattttattataagactaataaaatattttcatagatgcaaagaatcattatgcgtgtcatattgttgttggctgaattggattcgatatcaacagggtcacctaatataatatattcatattggtataatttattttaatatataatgtcaagcatatataccttaacttttattttgtagtttaatattattcataacgtctaaatttctgttaccaaaatattatattaatccaactcaaaaaaaaaaaaaatgaaatcataattttgttccgaatctgaatccaaatagttagtttaatcaaaatatcaaatcaaaatagggtcaagttactggaccaaaaaaggaaaaaataagaaaaggataaggtcaagttagacccgtccaaactctaccataccaccttatgcttacagttaaccaaaaacacctgcatgaattgcatttcacgccaccattaacatggcctacatcgcatgtacttcaagaaataaataagaatttatattttagcttttataaactttttattatttttagattaaagtagtagttattttaaaataactgttttaaaaattgacacaatgataaaagaataaatataaagtcttccacgtggaaataatagaaatggatcatagcatttcaccccagaaagaaaagaaaaaaggataatgtagaaaggagcaccacaattttgacaagttggtgaagcggtcataacagttattagtagtattttggagctggtaaagccgttaaaaacaatgtattacaaaaaaaatattactattggactggttttaataaaaaaaagaagttgcgttaaactattaatgaggcctacgaatgaatattggaaaagtaaaaatctatttggatgagttttttaaaagtatttttgagagagaaaaaataagaagagaaaagtgagatgaaattcccgattaattaaaatgaactctttaactaatattaattaatttgtaaaagttcttttatataatttttctaaaatatgaaaagacatttacaaattaattaatagattatttattttagtttattcaaaaactcattttatttttgggagttattattagttcccacttgacccctatcatctttcaaaaattccaaaaaatcctttctcataatgcacaatagaaatatactttcattgcactaatgggagggaaaaaaatattgtacaacaaaatcgcaattttattgtatattttttgcaccccattagtacaacaaaaatgtaatttcattgtgtaattgtgaaaaaaatgcacaatcaaattactatttcgttgtacaagtggggattaacaaagaatgaacaataaaagcataatttcattgcacaatatacaacataattattctttcattatacattttttttttgttttttcatacatttttttttgttttttcattgttcgataaatagaaataaattaagtattaattgcatgatttgtaacctaacaaaattacaattcgcctttgtcacaatttatataacatgacaaaatcattgtattacataaattacaacacaacataatcgtaattttattgtgttaaagacattgtaggtggggaagagagggtgccaatattgggagaaaggagacaaataatattttggcatttgtgcattgatagtagggactagaatcaattttggagtttccaatatcaatttccttaaaaatattgtttcctataagtgtttttatagagaaatttatcgaaagagaccgtaaggcctagcccgtgttggatatgagaaggcctctgtacgaagatgggcctattcatattacccaacccaaattgcgttttccgtgctttcttcttcttcttcttcttcttcttcaaccgaaaataaataaataaataaataattcccgctaacacagaagcttcttcctcaatcttcttcttccttctcgtacttccagttaaattttcgcactctcaacttcattttcttaaaccacagtaaaatggaaagccaaaaccaaagttagaagaagtaagaatggaagcaagtaacgaaagacgagtgctacctcgcagaaagcctctctccgatcgcaccaacacttcttctccctccgttgttcccctcaaacctcacaaaaccaaaaccccttcttcttctccttcttccgcaccccctaaatgcaccaccaccattctcgataatgccccaaaccctacctctccttctccatcgctcaaaactccctctccctctctccatggtaattattcattccagcttagcaatgcttcactttgaatatagcatgtttaattactctgtttagttaccgcctataattgtcgttttttttctttcttcttttcttcagagattgttgatgttgaagcttctgagcctattacagtcgtgtacagccgaagacgttcttcaaataaaagaaagaaggataaagggaaggcagtggctgttcctttcactaccgcgcccaatttcaagatctctcatacttggtaatcgctactaattactactattacccttctcttttgcctagtggaagttgtattgagtttaagaaacaatgattgagggagaataggaggagtgattttcgaatttccgtgattgggtaattaaatgctaaacattgtgatagaggggattttaagagaaatgctagtagcgcactcttttaaacacattgtctattattatttgctgaaatttattggaaattataaaattgtgagacctacttctcatttaatgaattttacttatgattctctagtttctactaaattgtaagtaacagtagagttacagtagagtttattagatagtgtgttgctacttaaacatttcacagttcttcaaaggagtttgctaaaagatttgtggactttgctgtttggattggctatatatgtatgaatgcatggaaaagtcttggtcttgtgaagctttcctgaatagattactgattcagagttatccctttatgtttcaatttttttttagtcggtcctgctttgctgttacaatgctttatacccttaacattttatgtttcattcgattctgttttggtatctatgttatagttggatagatccattatgtctcttgtcttgatttacggaattggatttgatttttgctttttattgtctctttcctggaagttctaccatataattattgttgtgtatgaatttgtgatgaaaaaacagcaatacagaggatgagtttgaaggtgtgaacctacccaaggccaaggcaatgacagttcctcgtacaaaggtatattaatttactattgtgttcccaagtttctgtgattttattaggaaactcaaaccccttgactgtagggatattgaattggttattcaacaagaaaatgttcttgttaaaaatatttcaatgagcattttgcgaggattgtttatttactgtttaagatgagtattcctgcctttttagtgggtatgtcaatctctggcatgagtaatcttatgtctgtcatctatacttcaaacaattttatgccaacctcccttgatatctacacagacaattttataatgtctatgaaatttattcacatctaaaatataatgggtattttcactatttgtacgttttgaatttgtgtgaagggtgaatcttgatgcaatggtaagattgccacctggtgatctggtcacgggttatatagcctcaaatacaatgtatccatccattgggatatagtgggaacctttttcactggaccaccatttttatagcatttggaatagttttatagtgggtacaatggaagttgatcacatttcaatcgcagatagttattgtgactcccaactatttagatttcctttgccatcacacgttactcattgtcctaataaaatctttgaaatagttgttgggtggaagtagaataaataattttctggtactttctagctcagacacttctgtttcctcctgcacatgacattttcttttggcagggggcttgcttacaggctatagattctgcatacttcttgtttcatgttcaatcatgtcaaaataaatattttgttagtgtctgatgcatattttctgaattttcagaaacagcgtgctttgtcatctgaaaaagatgagttcaaggatcgccagctgcaagaatttatagaaaaacagaaagcttactttaaagagattgatgaattcgaactggaggttgaatctggtgatgagttggattaggtggaagagatgtaatataactataaatagcagcttgaaatttccatgttattgtaggttgtatagttgagatatcgtgattttcacgatgaagtaactacctcgcagccatctctgacaaaatatattgtaatattctggtgggaacaatcgaagttaaaattttttctgcccaacactgtatcacattaattgtccttagtttttttttcttcttatttctcttgtaaatttcttctcaaagttataattcatttaatttgtgattttaatgcctgctttgttttaggctgatgattctttaaaatccttaccgggcaaatgcaaagagatacaaattttctggatagatagctagatattgtcgttcatttgatgctataagtctgctggttacgttgattgtcgtgcatttgtcaaagtcatgtgcatatatggtatacatataaaactacgtagttttttgatgataaactaggtcgcttgacggttcggggatcaaattattcgacataactttggaggagggaaataaaatttatattaaaaacatactatacatcataacttgctaacgtttaattgactttcccacaattgattctgatctggcccttgcttcctgtgagaggcttgatgttgctcattttgagcatgcccttggcaaagtcttcaaagaatgcagcagcattggtagcatattttcttaccagattgtcagtagaactgccattgaacagctcctgatcggaatggagaagggccttcttactcaccaaattctgaaagtatagattatcaaaattgattggagtttggtggtcaagggcttcgagtgttttgtcatttccacttctggggcacttgctctgcaggaacttccggtaggagggatcaacgttggaatcattgtagatgtgtgctctgaaatttttgcattcagccaggccaatggtatgtgcccctgttattgaaaagatgctgttagtaagttgaagcactttgtgaatatgggaagccaaaattgaattaggatcctgtcatttctttagtacgccagtgtttttacataggcagaggaaaacacaatttagtgcgggaaatggaaggtatcaaacaagaaaaattgtgtttttttnnnnnnnnnnnnnnnnnnnnnnnnnnnnnnnnnnnnnnnnnnnnnnaagaaaaaaaaaaaagaaatgaccaaattcactaaaatattttttcaagcacaacttttgaacagaaaagtggtaatttcttttagcaataaataggttgagaaaaactcaaactgacgagtgatagttttaggtaataaatagataggaataggacaccaccactcttgatcatgacaataatcgggaaaagattttttatttttattttattttttttattttaaaggtaagagtctacgataactcattcaatcaactagttaaatccccttgataaaaggattgttttgttactcacttaacaaccaagacttgagagtactagaatccgttgacatgtagaaacaaataaagacacctagatcaatacgatgggatatttgataatgaatgaatagagtgaaaaagagataacatgagatgaactcaaatagaataatataaagtgaaataaaatgcccttgattatttatattttatgtttaggaagaaatttttatcacattatttaagaagtagattaaacggaataataagaaaagtaataaataattaatcggttcaaatttcatacctcaatggaaagcagatgagtaaacaatgtttttgctggattgcatgaaataaaataattaaaattaagtgaaaagtgagtttttaattatagatatgttcaaaaaaattataataattatgtaaattttaatttgtttaaaatgaaaagtaaaaaatattttagtatttttcttaaaagtgaaaagaattagtttatggaaaaagctctggaaaggccgaatcacaaatttactttctttaagctcaattaaatggactatttatcaatttttatttaatttcagccaccttatttttaataattaaaacattgacgaataatatttcccatttttttgtcattgcatttattcatttttttaatatcacttctattcatttagttaaaatgaaaataaagaacaacaatttcctcactttttttatgagttcatctctcgcaaattctatttaaaagggattatttagtcaaataattaaattactaatgcaagaaaccgcacatgtcatcacaatcactacacatataaaagcacaactttaatttggaagccaaacgtgttaaaaaaagcatttgttttaacttatttttgtggaagtcttctatttttggaaagcatttgttttaactgattcaagacatcttataaattgttatagcacctgaaagagccaccaaatctgtaactgagaggccttgattggcaaaattgttaatcagagcagttagactgaggaaaggcccaggaatgctattattagcatcacttctgcttgctgtagtagaatctcttctccccaaccccacttcccaagaaggtcctcctaactgcaaatgttttacacaaaaagatatatagtaagtgcttaaattcaagggccataataattgataactttgactgggatagaaatagaatcacagaatattagtatagtagtattacataaactacagaatctctagctgacaaagcaagaatatcagcacatgacactactctggggcattctttctccacactggctttaatatcattaatcacgttgaaccctctagctgattggttgttagctgctgctgtttgctccccaatgaagttacttgtatcatccaacaggattgatgcatcacaaccctgaaatatcactatcttaggaaagcaacttcgaagaaattattagatagtttcagaccactacatgtttatagtttcaatcaatctctacgtgacatttattcaaaattttcaatttaaaaaaaaaaaaaactaataatacttaacacttaattacttgtcatataaagattatttgaaccatactgagccagactacctaataatttctcacaacttgcagcctatacaaaaggttacataaagtaaacataaaatgtatgttatattaaactatattattaattatatactaacgtttacaaagcagtcatggaaatgcaatcggagtaaggaagcccctatgcgtgcttctttctgaatggcttcgatcactcctttcttcactataggcaacaagtttgggcaggtgcatgagtaaaagtctgtacatagttctgccccagaagctgtagttgcaccgacgagaacaagcaagaggaagtagtaagaagccattggagctttcgtacagaagacatacccaatcattgcagctatctcttatacagggttggactaaattattattatttttaaaaataagcgaacatgtgtatttatgtatgaggcacaaaatgtgccaagagtcatttgaaaggatatacaccatatcccctgtatactatgtataccaatgagattgtggccgaggttacctaatattaacagtcatagttgtaaatatatgaattacctgtaaaagggcaaaatagtataggatcaatctgctgttggttgaggtggtgcttgatagacataacaggataaaataaaatataagaattttatttgtgtgacataaattaaaaatggaataggataaaatatatgatcaattttcttttaattctattaagatagtggaacaacaaagaataaacaaaaaaaaccttttttttaattgtatgttcttaaggtgtaatttatatttatttttgttaaacaacttttcttaatatcaattagttttaagatgaaatttagtataatattttgtttatgtacatcacctgttatggtaggcgtcaacttgttctaacaaacatatatgggtagggtgtgggaaaatctcaaatcatttttctcaaacatcacttaatgtcaattaatgtttaaatgaaatctaacaagagaaatacatgatctaagtaactcttatatttgtatccttgttgattaagtatctaagtagtcatgcttaattgttaccaacactttaattaaacatgaaatatcaatgaattgaaaaaatatttatctagtgtatctcccatgtgttggttagtcacaactcaataacttatgtatcatacaatcttctatatatccacaccatttccatcaaactttacgaatatttacattatctatatattatggatagataaattctacatatactcattgagcctgattcccattatctccttaatggcatggttatgcattttaatgttattgcatctccataaaaaaaaatcgaaaaccaataaaagcaaacgtaggattctttaattgatattgttggtttatgttatgtatagtcgaataaattattggtgaatggatttttattagtatttgtttatttttttataatactatattaaagctaagggtagagagagttcagctatctgaaaggagtctataaactagtctacatttgacgtagttcagaccatatattttaaaaaataaaataggtcaagatattaattaagtctaaaatattagacttaattgaggtcattcaaaaaaatcttttaggaaagtcgacttatttattttggtgaatacatgaattaaaaaaaaaagtgtaaaggagtgacaaattaaaaagctaaacttcagggcgtgcatcctataacacgagagcaagaacgctatctatgggagtgaaccaagtgttcgatataccagagttcttggatccccgacaaataagttgatctattaaagtaaatatgaataataattttttttatcagcattattatattaaaaaaattataatgtattaagataatatatttatttatccttttaaacatcgaatatgttgacttacatataagttgatttaaaacaagcatataaacaaattatattcaactcgtaaaatattatactctacttattatttcaactcttgtcctatgccttaaatagtagttattttaattttagacttatctaaaagcttcgaatatgcttttaaataagtaagttaacaaactaattaaggcaaactttcaaaaaaagcaggtcaaaattcaataaaaatcgttagtggcggtatcaaactagacttgaactttgatttttttttttttttaaaattctattgtcaattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatagaataatattaaaaatattaacttttatctatttcttatatgattagaagtacgtagcgaatgatttcttttcaaaaagtttgacagtctcgatctacttgtatttggggaaaaaaatgttctgtgagaaatcttgagtttttcaaaacttgtgccattgaacaggctttagaggaaattatatatgaaaactattgaaacaattgagagatgaaagtggttaagaacttagttagactttttaatcctattaatcaaaattcgtaaataaataattcatttgaaacattttcatgataaagcaattgttgatatacattgttctggtatataaaaaataatcttatattacttggaaattgaggctaaatgtagtttataaacactcattttccttgagtcaccgagagtctgggacatcttttattgacataacattcttgattactggtttcctctctttagaaaatgtgagtgaacatctgttctggagacttcaaatcgaaacacacaccatatgcatgagagtgtcttttattagatcgtagttgttgtttaattttactactgataaaaaaaatctaagcacacacgtagcgaacaaaatcaataatttacgggtacaattattgcctcgtggcagtgacaatttttagcagtttcgttattccaaaagtgagtaccataattgtttcgccttttctgtgcatggattgctcctgtggggctcaatcactgttgttttgtgggaggactggtcccccgtgataggttcctatgctgtgacagaaattattttacaaaattacgtgtaaaaatatagattgttactttttattttttatatcgacttaaatatatttttaatttttataaattatttttattattttaatttttgtaaatttatttttctaattttaatccatgtgatttggtatttttttttaattttgattcatgtaagtttttttttttttctttgtaagttaatgcttttttaaatttaatcactttaagattttaattttttttcatttataatcttatcgtgtttattatgatcaaaattagaaatatgtaaacttacttgaattaaaaaaaatatatcttacgtgaatcaaaattaaataaacacaaatttaaagatactaaaaatagacaaatttttttacaacaatcaaaactaaaaagataaaaatttatataaacaaaaaatatatttaagctctttatatataatggatttacataaattatttagtaaaatatgaaaaattatgtaaaaattcaataatatatcattaatattttttatatttattaaaatgtgtcatcaatataaaattctttcacatattatcatttaattacaaattatcatattatcattataatagttttactaactttcataaaattactttaaaagcatcattttttatgttattgtgattcatctttttgatatggtcatgtaccaaaaagcatcaccaaataatagtttctaattgttttatattactgaaattttcagtttgattttacatgacaattattgatcatatatattggaaagatgaaccacagtatcaatataaaaaaaaaaaaaaatcaaatgagctaaattagctgtccagctgaattgcggaaatttgttgcgatgattagtcttgaaaccagaatataccctgtggatatatcaaattttatttgaagcagaattaatgcaagatctatggatgacatcatttttgtgcttaatgaccggataattaggctttttgttgcaagaggcttctcatttgtgacaagctgaaaatggaaatcataaattaaggcgaaactatgaaattgtttgacttttaatttcaacgaagtattaaaaaagatatttctaaaattaaaattaagcacgcactgaatttccataataaaatcatgaaaagaaaggtcacaagaaaaggaattacgataacaatgacttttattctcttgaaataatataatactgtatttgaattcagacaattcaggttagatgatatagaatgttaaaatataagttagcatgatttcagataaaaaattatatatttaatttgaattgattataaatctataatcaattttaagctttttttaaagtcaaaagggaacttttatttcaatatcccccacaaaaagtatgagataagatatatactaccaaaaggtctataagtaattttaaattgaaacaattttgggtatgtcttgatcaacatttagtacatgtttaaaactaagtcacatcaatttcgatcaagtctgagacaagtaaatattcatagttaattatgcatcaattgtcaatttcgatgtgaatttttaggtttagctagtgtaagtaatgtcattccaaacacacgattagtgtctctcaacttgagtctatggtgagctaaacatgatttttctattcactatgatgtttggtgttgtgttggaaacatgattttgagttttagattcaagtctctgctattagaagtaacttttgtatcaacactagctttagtgcatgtttgacaatcagttggtgaagcaccaaacagaggttgttcaacgcatcttctcccttacttctgcgtccatttgttggatctccatcatatatagcaggcgctgaagcaaaataaacgtgctctttgtttcacatatacccttaaaagacttaagtcattttggtaattacacactactgaagatcatttttaattgtaatttttaaacaatattatatgttaaaatcattttttaatatttagtatctaaacaaaaattacattattacaaattcacagttatttataatcaattatgtaaaattactttgattcaaaataaattctatggcacatatccaaacattcactttgtataattttgtgttagataaaaaatttatactaaattttattattaatttttttaaagacaattttaccattaacttagaacaacaaaaatacaaacctttatcatattatttcaaaatcaattttaacttacaaccgcttaattacccaaatacacaaaaacaattttgtacaaatttaattatttattataatttttataaactgatttagcatatttattgacttttataaaggtaacatttattcacccactaattttggatttagttgaaatttcttaatcatacaagtagtactactttttgttctctcattcatgtatgaattgcttctgttcttgagcaaaagtagctttctcacaccattttcaatttcaccgacagcatcactagatccactaccttccaaatgacaggaaaaaaaaacattaagactagcgtcactttttttatttaatttatttcctaaacgaaacagaccattaatatcaagaaaacctcaaaagtaaaataagataaaatttaacatctatatatcgaaaaaaagataaaatttaacctctataagttataaatttgaaacatcactcgtatccttaaagtgatttaaatataattttactgtaaataatctttaaattcaattttttttagaaaaaaattccaaattcaaagatttgttgttttttccccctctcttttgttttttagtatttttcctccttaatcaatatgttagttagtgattcacagcttagctcttaagttgcgacatttacaaaaagataagcatcagttcatgactcgataaatcatgagttcgtgacataaataaataaataacgagttttctgtagcaaaatgccaatatgcacagtcaaattgtatctgaggttcgggtgtcagctggggccatgcctttatcgatcatatttttagcttttggaatttggtgcctaattataaaactccataaataaacatacaaaaatcaatcttgaagttgaacgaatgacgtgacgtatgtgaactggttacagtttacactttacatggttgcaatgcaatattaatggtttcattttttttcctgaaaaatatatataatttttttattttgttcatgattaagttctttgtaactaatatttaaattaaatatctgtcttaatttgttcaatgcattcaaaaaaaaattgttcaacgcgaaataagattttataatgaatatcaaattgactttaataaaagcttttttatatataattcaacgattgactagtataaattaaaaatcatgttaatatatatatctatagtatgtttagttaaatatttaatcatgtcattaatcaatgtagttacacccaagatatatttcaatagttttcttttagtttacttaattgtgatacttttacaatccgaatcacaaatgagattacttaaaaaaaaaaggaactaaatgaaagcttcgttgaaacttagtaaaatcttttgccgttgttttttattctatttatgtttttctatttggtaagcgaaactgagatgacccaaagtatcaaactggcctgttataaagcccaacaaggtagcaatgttatacgatttggcaacaaattaagtctggcccaaggatgttttcttttctacctgaatctaactctgaacgagttaattacttgatcaaacaaacattgtctgatacttgatcaaacactgtttaaagtctttaaggccaaatatattttatttgtggatttcttggatgttcaactcgaacataattcaagttttgtatgaagtaatattcacacttcatgcgtagaccgtagtggtaaaagaaggtgttcaatggagagttgaaaatggtgaatccattcatatttggtctcaaccatggctcaacaatgttcataatcccgatgtctcatccaatccaaattctggtaattataatcttagtttctgacttaatgaccataatatttctgtttggagaaatgaagttttggaagcaaatttgtactcttcctctcttgaacacatccgggaaagatcaattaatttggagattttctgcaactggaggatatactgttaaaagctcataccatgccattatggaacaattgctggacaattcacacctcaaggtcgaaggagattgatcaataatttggaaacttgcagtgcctcacaaaatgaaacattttctttggagactcatgcgtaactgccttcaaaccagatcaaatctacgtgagaaacaggttcaatgctcactgaattgtattttctgtcaatcaaatatagaaaataaatgtaatctctttttggcttgtgactatgcaaagctcatttggcaagcagctgacctctggaacatgatagaacaaagatggaataatgctgaatcttttcaagaattcatgataagaacccgtttttgcaccattctttgggctatttggaaatgtagaaacaagaaactttgggaggacaacgaaacaactccatgttgggtcaaaacggatcttcaaatcaaatgcagaagtagaacaaaaatgtaagaggagagagatagagaaaaacacaatcaatatgtttaacgtgggaaaaccttcttaatgtgaaaaaataaaatccacgagacaccaatccaaaatcaaactttcactataacaataatgggttacaaagaatcaaaatacaccaaagtggtggttcacacaacctctccaacaatggtgataatcaaactctctagagtgtttcactaaaactctctctagagatatctcaaatgtaaagcacaagacttgctcaaatgtgctctcaagaatgtcacttgaggcgtcaaattctgacctaattctttcagtcttaagtctaggtcagggtttaggacagcattagaggaggaagcccaatccaacaattctccccctacgacttcaatgcgttggcttcagcatcaacccggcatctgccaacaatccgacattttcaatgtgacggattcagcaatccaacccggcattttcaatgcgacggtcgaatcatcctgagaattccacacattcgtggatatggtcaatcacgctcaatggagactcaggcagtgtgggtggtgggacatcttcatcatgatccactattctatatggtaaatttgtccagcaaaatatgccattatttttaaaaaattatttaaatatgcctacctatgttcattaatttttttaataaacaaccataattaaatattatatagcttagttaaaaaaaattaatatcctaatataacaacattgccatttttattatacataattttattcactattttgtgtgtctgtataaatatattaatatatatattttcatgacttcaaatataatacattaatacattaaaaaattataccatatgaaaagtttataaattataaaactagtttttgtacaacacacatgttactaagctacttaaatataaatattaaggtaagcacattattgatattatatttattgcaaaatcatatttttaatgatattttgcgtatattatgtgtattaatttttaaataatattgtcaaataattttgtaaaataatatatttattgaaattaatatgtttaattgtgatatgcgtatatgtttaattttttataatatatgtttaattttttataatatatttaaaataatcaaattaaaaatataatgtatatataagtacaaattaaacacaagtattaaaaagctaatgtatatattagtaaatttagttatatactgaaaaatatttttttaaatcattatgttcacaaaggatgaaataacaaaattaaagcaattaaaaatatatatatatatatatatatatgagtaaaattaaatacaataaacataatattctgttaatataatattttcataaatatttaaataatttaatacctttcaaattatatttattaactataacatataattaattttaatagtattactatatattatattttttaaataatatatttttatcaattaaataaatataatactcacgcacatatatttttacctactacttcctaaattaatctataattaaaatatgcctatcacttgtcttataacttaacaatcataaaatataactaaatatcctttaacctaatgtttcaaatctcaaacctatatattatttcaaaactaaaactatatgaataatatattacaaaaattaaaatatataatgctaaattacaaaagataaaaaatagaaaaatagtcaaacaaaacttacctgttatactgcatagggagggaggggagtgacactgagagatgggagtcagagtgagagtgagcttcagaatgagagtaagggaatgatggatgaaggaggggaaagatttaaatagtaagccatgtagacgtaatttcctggggtctgcagcgaattcgttcatgcgtgacacgtgtccacaacgattctttttttagattgttgcacctatttcgctagggtcaagcgaaatacgttgtgcgccatgtggactgcccattttgtaccacgtattttgctggcacttgtagtgaaataagtgaccaacaaaatgacgccacatcagctcacgtatttcgctaggccttgaagggaaataggatgcgtgacaatattgtgcatgtggcatttaagaaatttttttaaaaatttgtggcagtactgtcagtgtctccatcattatggggtcaagtgattgaggatgcgaattgggtgtcaaatatacgtgatcaaccatttcttccccagtctctgcaaagcaaagtgttgggttcaccattcttatcttccatttgtcgtccatatatcttgcaagttgcagatgctgcattaattttcaataagctagctggcattgtgttaatattgtgtctctgttactcatttataattctcgctgataatgatttgctaccaactgggagaagaacgaactaactagcacaagcatccaaaaccattggcagcaaaacggggacgaaaacactgcttatgattagattgttcgtttagaacagtaagcggaacatatagatagcactttatggcgatgcatatgtaactcatttgactactacaacaggaaacattagtttatacacatcctcttcttatatatatatatatatatatatatatatatatatattatgtaaatttaccgtgaattaattatactaattaatttgagccctttttttttctgaatgtaacgtgaactacaagaaattcattcaaaataagaaaaacgtattcaaaagagtgctgaaaaatgaattgttctttctgcatgtccccttccatgaggacctggagtttaatggtccttgaattactgatcaaaggataatgacttagaatgacttgtctaatggtatactatgaggcagtgatgtgtagctgactagctaagtgtgtgtatgaatatttaaagagcatcagaaccttgcaaatctagcagtatactatgaggcagtgatgacgaaacttgacacaaggccgaaattccaccttataaacacaccgtgacagcctgacaggccttccttcacaaactgcctataggggttggaaaaaaattggcgacgcattttgccttggcagtaccatgaccgctatgtaacaacactggtctgtggccttgattcacacagcctcaagatttttgggtacaccttgatcgcattacagtcgcatcggccccatttaattactagtgacttaatttcccgaaatgttaaaaattacaacgaaattataactatgatcgcaatttaaaacctcttgctaactagtttctatagtttcaatatgttttcttttagctcttgtacttaaaagcaccttttagtccctacacataccgttttaatcacacaatttcagatctttatacagtcagtaacaccgtttggtcaaccgactctgagacagtaataagcaacaactactggccattgtaatttctgagtcggaatgatgagaaaattcaatgctagctaggaatgagaaatagctaggcgtgtgaagaacgaaataggtcgttgctcttgtaattattataagcaactatccaaagaatttgtggacatgctaaaagtttatcataaggtgtgaatatatatggagatctttatattgtttttttaagtcgatgaataattcttcacagcactaatacattttatggttgaggtgttaattaaggagtcattgatagtgattagtgaacgtgtcgaattaatatatgtgcgccattttagttacatctatcctctacaaccatgctatgacaatgccctcagagtcttttaattagttattctttgacattctcagttaaatattgctgcatgtgtaatgattgatgtctccgttaacacatggctaattaaagccaatcatttaactaaggaaggtatgcggctgttatatttagttgcttagaaatatctaattgttttgaagttcatgttcagaaacaagcctttcatgaagagcaacaatcattttaactgcacacacatagtgtagtacattttattggaaatgtaaaaaaacgaaagtgacgttagacatatttttttattctaataaattttttgcatataataggaagagagataaagaaaaatgaaagttattaatagaatatttaaaatattggatgtgtcaaaatattaccactatgcaagaaaataggaatacatataggtgatttgagtgactgcgtgtgtgtgtatatatatatatatatatggcacccaacacctctttcttaattaacatcacaccattgatctctttctccttttattgcttgcttctttagtatcactctgctctccctataatatacttctaatggaagccaaattagatgatcatacctaagatgcatatggtactgttgacttccgcggccagcctgcgctttcatcgaatactggcaaatggaaggcttgcatttttcttcttggtgaccataataatttctaacctgtttattaagcttttataagaatctgatttgtttgatcatgaacttcactaatattttaaacctttttgaagattacttcaatcttgaagattttgttctctagaaaagaagagaaagaattatactgtgaaccttcttccacataggctaggggttttttattttattttattcccatgcgcgcacgttagttcagctctatttcctggttcttagtttaaactttaaagtctaaaagtacatgtcaacttatgagtcttagtgcttgtgaataggtactatttaatgactgttactgaggagtatggttttgaattgtggtacacaaccgcaattacggttacaacatcaaagtattttgtcactctgtaatcgtatcacgaccgtaattaggtcgcattaactgcaactgcgatttaaaaccatgctaaggagatacaaaatgaaaatatcaaagttccatttcatataacttgatatatgatgcttgagctttacttcttttattagttcaacattgcaggctatgaagcatttgaaaggatggtcttctaaggagttgcttccaacttaatcagttaccttactacccaacttcatgaagatactgttccatctgtgaataactggtcagcatctgtgtggataacaccaattcttggggattacatagcatattcttacttgggtcgcttttggacattcgctctatcatctctcatttatgtcttggtaggctaggatttaattatcacaaacgatctcacatgaaaatgtttggaagacattcaatgtgctaatcaattcaacacctatagagataggaaaaaaatagaaaaaacaaataaaaatgtgatagaaaaaaagagataaaaataaattaaattaatgttagtgatatgtttaaaataaattaagtgtgatctgaatatcattactctgatataatataatagaaaaagagaatttaaaggtgttgatggagtgattgtagtttgtggtgtccaaatatcattgcgatacatatataaacatgtatatgtgtttagcaaagaataatgatacataatcatcttttatttttaaacattttattgatatttcatatttctttttaatttttttcttgtcacatcacaaatcctattatacctatgtcttttaaagttaatgggtgtctatcaacattttctttagcaaaccacttcatgcacgtacttgtgcctctcctcgtcacagggcatgattcttctcactttatgcaccaacggcatctgcaacaaggcttcaaccttacaaatttcttttttttacacggcactgtacactatggcagttggggccggtggaacaaagcccaatatctcaacctttggtgcagaccagtttgatgactttaatcccaaagagaaagagattaaggcctcttttttcaactggtggatgttcacttcttttttaggtgctttggtagccactttaggcttagtctacattcaagagaatttgggatggggtctttgctgtggcatcccaacggttggtcctctattgttccctgtaattttctttacagggactccaatttatcgccacaaagttaattagggcagccaaaagtcctgccagagacctaattcgtgtctcaattgcggccttcaggaaccgaaaattgcaactccctattaacccctcagatctttatgagcaccagcatcaacattacattagtggtggaagaattcatctggctatttcttgttttgaggtacacaatttttcttttatttttggaagaattcatctggctatttcttgttttgaggttggtaggaaggaagtgtttatacttcgcagtctagtaattaagaaaaatataaaatgaaaaaataatgatacacaaacatatatattttttatatatttaattaataaatatttataatttttttcttatttctcttttcatatcatattataatatttattaatttttttcttttatctttcactaggtgtttaatgaaatattgaatcttcatgaatattttttcaaaatgtaaacatattggaacgagcacgttttcataaagaaaattatgcaaacaattaattaaagtgaatgtaattgtggtaggcgacttatttgattgagtgacagttcagttaacatggtgtggtaatgtagttgtagttgtggttgaagtaacaattgactagatgtggccatgataataatgatgatatattagttatgctaatagtgtttgtatctagagataaaatagttgaatgatttgcttttgaaattataaattgaaaattaattaaatatattttctttaaaaaaaacaaggtaaaattattttaaaattaaactaaaaatcaattcaattccattttagttgaataattattttttaaatttgaatttaaaaactcacatccaccctggtccaagtcatccctaaaaattaaaaaattgaaaaataattttaaatttcaaaaagatttcaaaactcatgaaatactagttacctcatcaaacatggcttaagtgcgctttatatattcaggtttttggacaaggctgcaattaaagaaggtagcaataatattggttcctcaagaacaccattaaccgttacccaagtggaaggattcaagcttgtctttggcatggtcctaatatggcttgtcacactgattcctagcacgatatgggcacaaatcaacactctttttgtaaaacaaggtataaccttggaccgaaatcttggtcctaattttcaaattccagcagcttctctcgggagcttcatgagactctctatgcttctctccgtgccaatatatgactgatactctgtgccattcatgcgtcgaaaaactggcaaccctagagggatcacgttgcttcaaaggtttggaattggactttcaatccaaattatggccattgcaattgcttatgtagttgaagttagaagaatgcatgtcataaaagcaaagcacgtagttggtcctaaagacctagtccctatgagtatattgtggatgttgcttcaatgcattctaattgggataaccgatatgttcaatgcaattgggttgctagaatttttctatgaccaatccccagaagacatgagaagtcttggaacaacgttcttcactagtggaatcggcgtgggaacttcttgaacagctttttggtcacgatggttgataagattacaaggagcgagacaaagagttggataggtgacaacctcaacgactgtcaaatggattactattatgggtttctattaaccctatcgattgtcaatttaggtgcatttttttgggtatcaagtagatacatttacaagaaggagaccatgcatgggtgaagagagtctttatgttcaagtgtaaggcaaagtgtgaatgtgaaatatcatatttttcctattttctttatttggaaaatcaaataaattagtattttaattttatttgcttatatttttattaatattttaatatagttgggtggcaattatattgtagttaaattaaaagaatatattaatttgtcgtggtaatatatcatggatcttaataaataaataaaaacgtgtgtgaaaatgaaattactaagctcaaagattagaaatgttgtttgataaaaatgcatgaattaatttttgtgtataaaataattaattaagagttaaattgaataattaggagagtactaaattaaatggtatactaacaaaaaaaaacttaacaataatgacaaaataatttaatgtaattttaatgacagtaacacaagtattagtaataaaaattacaaatagttgcaattttgtcgttaatgttttaatttcttttttttttctagtagtcattttgagagagatattaaaggccacaatttataagttgtacacatgaaggctcaaaaaaagtccaacattaaatatattcacattggaaatgtccaactaaataagtccttatgaatcacatgaagataagctagactaaaaaataattagttattactttcttgattaagttaaatgatcttgggtgtataagttttacaatttctcaataagatccttttcatatatcggaaaaataaaactactacagtataatttatcattatatgttgctaataatttcttttatttattttctctacaatagtgtgtaattgtgaaatttttttaaaaatgaagattaaggatctagagtaaattttaaaaagttactcttaataacttatcctctctctctctctctctctctctctctctctctctctctctctctctctctctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctatatatatatatatatatatatatatatatatatatatatactcaaattttatataagatttgaaacaatcatatagtaaataggtattcggtctaagccaaatacccattatgctccaataaaatctttgagacatcaaagcacaccctgtaataggactcgacattcaaacatactgaatatatactcgaagaccacaattcctttattctataagattactgctacgagtacctaacactacttgtagtatcagatactcggctaggccgagtacttgaacaccccttggtattccacaatgtcgaatacctgatatcccttatagtatcgagcatttggtttagttgaatacctaataccatagttgtgaaaatcggttcggtcattgacccggtcgagatagtgggtcactgggtcggtgggccagtaattggcctggtttgacctggtctacattaaaaattttaaaattatattatatataaatatataactaacattatttgattaaaaaaaagtatactcaaaattttaaaataacaattgaagtattaaagttgataatagaagtaaagtgtattaataataaaagagaatgtaaataaaaactacttaaattaaaacacaagtttaatttttaattaaaaaatgagcaagaggattataaaaagcgaagaagggagtacatgaagaaaattggcccaaataaatgtaaacctaattaatgatatgtatatatcttcgttgtgcctctcatcttctccatttttgctactgcttattgcagttgcgcttccgcttcatcaactcatcaattttcttctattttcctgcacatgcgcttccgcttcatcagctcatcaattttcttctattttcctgcagttgcgcagcttctccatttcatagtgtttcctcttcctcttccttcgcgttatcgaaggtgaggccgacgcgacgagcagtgcggcggtggttgagttgagtggcgatgacgacgtgcacaacccggtccgagtcctaaaaatcggctgggtctccggttcttcccaaaatcactcgattttctccgaaccaaaccggaccacatgcatgagcagtccgatggccaacctagcccggtcatggcaccgggtcctggttggaccgatccaatcggccgggccgaaccgggttttataactatgcctaataccccttgtagtatgaggtacttggcctagtcgaatacctgctacccctgttaagtacccggtctaactgaggactgaacatgtctcatccgatctttgatgacttatgtagagagattacctagattaatgggtaaggaataattaagtgagagatcagttccctgatgataattatagggacattacctaaaatggtaactttgaaaaagtgttcatagatccaaggtccactaaggtatgcataaataattacataaatatcgagataataacataatttatttgtattcattatcttcatttaatcgtcagagtctctttaacatgtatttcccctttgagcttgacaagtatcatttggagaagaagaattacttaaaaaacataaacaaagaagaaaattacttgcctacccggacaggtacaattcctatagaaatgactgatagatttggtatgaaattaattaattgttatcattaacgaaatataaagtcagtgaggtcattataagttgataaccatctatctatactaccacttgaatcagtaagattatattctaattaattcatcatcaacgtagagaaagataaagcaaaagaaagccgtgaaagagatatttaatcaatttccaaattagccagttcatctgtaaaggcctaaagggcaagagtaattatatctttttacgaatttctttccctccccgagcctatccagcggatcattgtttaaactttgacaattcaaacaatttaatgtgaacccaatcaaatatctatctatctatatatatatatagacataatgcttttgtgatggcatgcttctggcatggtttgttagtggttacgttttgtttggttggagctaccattagcccttggttaatctatattcacattattttgtgaatatggtataactttgggctacatgtatttctgatgatcttgtaaatggttggggcacccatttgtgtccttctttttttattaatataagtttttctgtgctgattaaaaaaaagtagagatcctttgcatcttgtgaactcacgattaggtaaaaataaaatcaacatcttaaggttaaatccatttttatgttgaatgctaacaatgtactaatataatactattttatttaaaccaagtttctagcctcatggcacaaatattgtgtaggaaacgttaccagaaaaacagcgactgtgtgtagttatgtcaaagcaatcgacaatcgaatcttcttatataattagtaaatggtattagttaagctttagcgatggggttataataaaggcttgattatcttaatcaatagctgggtcaggctatatgtataggagattcgttacacttcgtcaaacttaaaatatttcaaaatgaataacaccgctttcattctctaatgatatggtcaagaccaatattctaaacctaaatctcctcctaattttccaaagggcactctgttcgcggccagcatgcaattttctttaatttggaagaggcaccgtaggagggagtgtatgggccatgcatgcgcatggaagtcatctatttcctaccgtaatataaaaggcacaagggaacaaaatgtgacaaagttattccctgatcatccaaaacttattgatttttatcatatttatccttaaagttttagttgaaatatacattttctttcatttaatccacttttataaagagtatcctcaacataaacttaaaagccgcgccatttttttcagcaatttttaatgtgtttggtaggaaagaaagaaatacatgaaaaatagagtagatgaaaattgagaatagaggaacagaataaatgaaaatagttgagaaataaagtaaaaataaaagtatttagtttaaaaaaaattaaaatcaatttttaagataagtaattgattgtgaagaattcatagttaattggttttggaaaactaaggttcgtttgattcattaaaaattattggacataataaatattttttatttcacatttgatttgaaagagtagagaacaacacaaatcaaacaggtaagaataggacaaaatctctaatttttgttattcagaaaattacataataactttttgtcatagatatagaatattaaaagacacatatattcatgtttatatctctttaataattgaaaaatagtaatcaattaacgtaatcaatttaaaaaagacaccaaattattttattctaatctctctctctctctcttatcatttcagtaaattcattaaatttgatatcaattgtattaagataattaacattatgtattttaataaattttatattattttttgtccattatttgtcaaataatatataggataaaaaatcatcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtatttgtatttccaggtaagagtcggagattaaaccattatattgagatatggtattgtgcctcttttgagacccttgagcaatagcataattattcaacaaattatatacttaaaaattatttgaatgtggaacttaggactgtatcagttaatttctctcttaattcattttcaaaaacttggtattttccagctaatcatgatgagctaacttatttaatctaacacatgctattttttaggagtactatcatgccgttgttgttgtttcctattttatggggattaattagccttttcgcgggttaatgtaaatatttaataactttctttaccaactttagtagctagttgaattacatgtacaacctaagtctatttagataagttttttcttaaatatttataagaaaagagaatacaactagtgaaatgatttgaattacactactaaggtaaaataatttgatctcaacttatgacttctatagtttttattattatttaacttcttcaaaacgttgattttagtttgtaaaaaaagttaaatgtattttctttttattttatttttcttattaaatacttattgaaaatggtcctacttcaaacaaggaaatgagtggctgagaaagaaaaaaaactcaatctgcctataccttcaaccactccaggaatttgaacggaggaagagaggggccaggggaaaaatcccttgttcggttgttcctaacaactcaaccctcctttatctttgaccgtcacccattactttctccactatactctagttttaataatctttttgaaacagtgggggaacaattttagtttgcttcgtagtttttatttttatttttattgtttatctccactttttttttaggaaatttattatctccacttcagataaagcagttatcttttgatttttggtttaaattcgttggttatgatcccatgatccattcacaattgatgattataaatcttgctagtctaataatgtatttttgttgatccatcctaagtgctagcttgctataattattatttttcaggtaattaaattggtggattaataaatatcagtataaataaatatcttaaaaaaattaaaggaaaaatctctaaggattaacaccaaaaaatttatagggtgccaatggttagtcatttaatttctcacctctactagaaataacttaaacttttagtgtgtatatatatatatatatatatatatatatatatatatatatattgtgtaagtctgtgctaacattataattattattaatgtatcgtagtctagcaatgtaatgtatgtatggtatatatcaattttctacactactagaagaatcaattaatatataaggcatcattagtataaatttagagtatttatatatatttacaggtttattttcatcaaacaaaatttatattaacaaagacaagcttgaaaaaccaacaagataattaatgaactaatattttttgtggtgagtaccaatatgtcattatgttttcaataaattatattatttttctttataattactactatttccctaacattagggtgcggcgctctgccattgttcattataaagttgtttttaatttaattttaaacatgtaatgtgttgttnnnnnnnnnnnnnnnnnnnnnnnnnnnnnnnnnnnnnnnttctttgttaaattaaaaaaagttgttgaacaaagtttataatttgagggttttaattattaatttttttgttgtggtttctttctccacagtacaaattttatcttccaaagaataatatagtttccattacgccatatttgtttcctattttttatgaataaaaagaggattttgtttatgaaagtatactagaggtacttcaacccggccagcatctagagggaaccacctattacattaagtaatacaataacgagatccttcaattttacggtctatctaggattcattttaaataaaatatcatttttttatcagcaaatattcattgttagaatgttaattttattaacagaaaaaaattgaatccaccatctttctcttatttcctctccattaaccatccaactcatattaaatctccaaaatttcatttctttgaatttatattgaccgctgtgtcaccgactaaattgatctccgaacactttccaagctgttggcgcctttgcatgtaatatatataacttgtataatgtggttcacagtgtataagtctacaagagaagaagaataactaaagccactgcatatataataagtataatgtggttcaaaatgtaaaagagaagaataaataagccactgcaagaataagttaaggatcacgcgcgccttatcaaacaattttttggtacatgtaaaccctaatcgtcaaaaagagggaggtacatatcattctcacgtttttttttttttttattgttccaatattccttattaaagatgaattcctctttgatattaatgcatacatcatacattatataatataatgtgtatacatgattaaatcgattcaggtatataattcaaatttccttcacgctttaggtgtttattttggaatctttagattaaatcagcagtcgaagaagcttcgcatttttggctgccaagttgtatcgattgcacgaaaatatcacacatcaaattgtgggtaacagtgtaacatcatataattataatatgggaccctgaaaaaaaaaaaagtttactaactactttgccaacactgacaaaatcatggctagccggcgcaagtcactactggttcaaagaaaaacgaagcaggtttatgaattgattaatcaaattacaaaccaaaagtaaacaactccatgcattgacaacttctttgctagttctgcgtgttaggttaggtaacggaagagagacaaagcaccttgagatttaatctcacattaactaattaaccttgcgagtggactagtggccatataaatatgtgacatatgcacgcacttacgaaacacatattctcatcacatagagttaattacttacttggagggttttagagaaatggcttcgtcttgttctagctttatgatcactttggcccttttggtcctcgtgttggggactaatactagtagtgccaatgccaatccaacacttcacacaaacttctactacagttcttgcccaaaactctttgacactgtgaaacgcacagtggaatcggccatatcaaaggagacccgcatgggtgcttctctcctacgtttgttcttccacgattgctttgttaatgtacgtaatttttttaacatttcttaattaaacactcttctttctttcaattctgtttagtcctagaagttaacattttaaattttgccttcttgtttctttccccaacattttttactttacatttgatttgagttagatacgttatggggtcagtttgtttaaatttattttttgaaataagtatttattttaataaaataagtcatttttatttatttttttatgtttgtttaaattattcttcctttaaaaaattaatttttattcattttaagaaacaaatctcatctgtttccgaaaataatactttttttaaattatttttttaaatttaatcaaactcacctctaactaactgattttacataaaaacaaacttttgtagctagtttttgcaattacattttgtacaactcttgtactaagttactaaagtaaccccatttattatagttcatatcaatggtggttattcatgatcagtgtaatttatgtccaatagtaattttacttttgttcaactttgttgatacatatatataaagattggataaataaatattatatatgttgcaggggtgtgatgggtcgattttacttgatgacacatcaagcttcaccggagagaagaacgcgggacctaacaggaattctgcccgtggatttgaagtgatcgaccaaatcaaagcagctgtggagaaagtgtgtccgggtgtggtttcttgcgctgacattcttgccatcgctgccagagactctgttgagatcgtaagcaattatttatttgaatgtcattgcatatagtttaatacttttttggggtacatatatagtttaatactttaatcatgcatatatatgtatatattttaaaaatcagagtatctgcatggcaattatttgctgtataaggaaggagaagaaaagaaaaagaatgtaaaaaatgtctaagatattcctgataaataattttatataagacaaatcctttttgaaaagacttccacactaacctcgacaaatgtgattaaaatttcagttttctatttgtttctctatcacttggagaaaacagttattgtcattttcattcttaatttgccttttttttttcttccattttcacaccaatctaaacaaaggaaaatttagcttgcgcgtttcctttgtacatgaatcaatctccacttctccattctgcacacacatcacaaacatatgcaagtatacgtaaactgaatttttaatttgttgaatttgatcagcttggaggcccaacttgggatgtgaaacttggaagaagagactctaggacggcaagccaatctgctgccaacaatggcatcccaagacccaattcaaacctcaaccaacttatttccagatttaacactctcggattttccactaaagacttggttgcactatctggtattattatacaagagtctaatatcatgctctcttaacacattaattttaacacactgtgaatatgattaaaaattacaaaatgagttcctcttggtactttttaattaacttgttaccatagcaacaatcatttactctttttttatttttaatttcattccattgcatattctagggggtcacacaattggacaagcaaggtgcacaacctttagagcccgaatctacaacgagaccaacatagatagctcttttgcccgcatgagacaatctaggtgtccccgagccacagggtcaggggacaacaaccttgcacccattgactttgccactcccactttctttgacaaccactacttcaagaacctcattcagaagaagggtctcatccattccgaccaagaactcttcaatggtggttccactgactccatagtgcttacctacagcaccaacccggcctcctttttcgccgatttctccgccgccatgatcaggatgggagacattagtcccctcactggctccctcggagaaataagggagaactgcaggagggtcaactaattgaattcttaagagagctacacataatttggatatcaatgcatgtgtgtgtaataagttgttaaacgagagttttgatttcatttctatgttgtgactttgtgtgctaccaagtgtacgtacctgcattgttctatttcaattcgttaatttaatttgcttctaagtggtgatgttgaagatgaaggccttcgctgtacaagttcctttctgacttaatttccttttacaattataattaattattattacactagctcccatttttatgttattttttgctttttatgtcaatttaatttctagcttacttttcatatttgttaccaaacttttattctgacgtacgcaaataattcatgtgaaattccatttttaacatctcatctaattcttttagtagctttttcaatgactcttttcatctacgaatgacaaattatgaaatgtgaactgaaatcacgacatctcaaacattttttagggtctaattgccagctaattaatgttctttgttgaggatagtcctcattgcttactgtcaaaatgtccaggctaaatataatactcctggatttatatataagtaaaaaatattgttagatttaaatataaataaatttaactaattttatcttatttagtgctattatttttaaaatatcattcttttaattctaattctattattaatgattcatcttataataaattttaatgaaacacattttaaaaataactatatttttaacttgaaattaagaaaattaaatgattttaactaattttttaattagtgtgaaattaattatttttacttatatgagtttagaggaaatacatgattagaaagttatatgaggcacgaaataaaaggcatttaggtgaaggaactagctattgattttactattattttattaagtttggctaatcaatatttttaggatattagttaagaaattaatataagaatctaaggagtaatgacaatgaatcgcgtcacctaaccagatagatttttccctactcttacttcaaaccatatcgatctaaaagaacaagtaccatgtattctaaacgtcgttgtcttaatttttgttatgtcataacactttcctatttgagctaatccattctatttttgtcgcttcacctccttctcaaaagcttttcatgacttcgtttattatttaggtgtttgtttccaatatttttctagttttaattggcactaaacatacaatttggtgcctcgttaaaacattgaactttaaattaattttcacaacaaagaaatatactccgatcatctcttttgtccgcactgtcaatataagcaataattttttttcacaatcaaatacacgagattgatatttattggatcattgcacgtatttttttttctcttgatttgtttccggaaattactttctgcacgtctctaattgcttcctgtacctattctgaaatgtaaaattacatttcggaatagtcaatgtaaaaatttatcttctgataagattatttcaaaatatatttttacattttcaaaatagatgttccagaagttcaaaaaggtacgtacaggaaaaaacattaacaattatctttgttttgggtcaatggagcaagtgctcatttgatatctaagaaccgaaaaggaaattgatattggccctccaaaattgtttttgggctttacctgcaaataccaaaatgtctttttgtttctttcctcccatattggcatccatctatcctttcaggcaaaccaaataatcacgtttttaaggtgttatagttattttactaaattgtgacaaaaagaaatcatgattctggctagccgtcactcccattcaggcacagctgggatagactgaatcaggtagcagttactttctataataatttttgcattagaataatactttcgttgtgcttttttttttttcagaaaaaaatgtacaacacaaatttgatttcgttgtacattgtgaatgaactcatatttctatatactttcttaattgactattgcttactcaatgaaatcataattacattaaacactttttttatataccaaactatacaatgaaaatatatttatgttgaactaatgagaatgagaaaaaagagtataatagaatcataattacattatatataattggaattgcgatttcattgtataatatttttcatatcccaataatatagtgaaagtgtgctttcattgggcattatgagaaatgacatttttagattttgagaatcttggtagggcccatagcaacccacaaccaaagatatcaatacgcgcattttgaccattggacaatgcatgtttggagagtatgattaaacatatatgagtgggcctgagttcatagatacccatattttggttctatttgggctttcttcagtccaaatttttggtttttgtcgttgagtatttgttaggattaattacgaaacaaaatgcattatgattttgtttttaagcgaaacaagattaatttgattaatcctatcatgatgttatcttcgtctttagcttttgaggggaattagatgctctctcctgaagcctttctatcataatgtttttgagagtcgttaaattcatgggtaaattatatttttaagtttcttattttttgtcaaaattgattttgatttgaaaaccataatttttatgctcatattttttataattaataaattttatttctctttatggaatttaagatattagggtgagaaacaaaattttgtcaattataaaatatatgaagataatgaccatttttaaagtataagaactaaagtcgattttagaaggaaatcgagagatgtaaaatacttttttttctaaatttatttatttagggctttgtggtcagatccaattcttatttgacccaaaaagcataataagttagtaacagttagatacagatgcatttgatgtaaattaaaaaacaacacaaataaaataaagcaagcagtaagtgattgagataggtgaaaattttaaacgaacaaaataacatcttgagtaacttggtcctctctctcatacaccagtcaattcctaggaaaaggaagggatttggcaaaaatggaggattagattggaaatgcataattgtgaaactcggtttggttattgatccggttgagatagtgagtcaacagtttaatcggtgaatcaataatagacctgatttgatccagtatatattaaaaattcaaaattatatatgtatctataatatataagaatataacgaatattatttgagtaagaaaagtttattcatactctaaaatccaaaataacaattaatgataatccaaaatctaaatttaaaaaaaaaatccatttttttaaattcaaattgtttttaaaaaaatttataaaatcgacagccgagtttgactgaatctctttggattaactgcataactgatccgaataggtcatcggatccaaatccaatcgaccggactagatgggatatcacaacactgaggaaaggcctatcaataaaaaaggcatcagtttaggataatgatagtccaataaaagaattctttttatataaaaaaaaaatcgaattaagatagagtcccaatattacttctttagttttgtttttattgtggaaacgggccgaagtgatgataaaatagtggagaaggaccttgagatcacacagaactcatacaatgttagaagttcaagccaataatatatcaaacttaaaaagcgtgttgtgcatgaatttttaaagggaagtataagctagcttaaattgaataaaaatttcaagctgtatgtacccaaaacagaattatctcatgttcaaattccaaatttactcaccttgcgtcatgttgtgttttgctagctgtagttattttttaacttcccttctgtatcaccaaaaataaaataaaatagaactgtactcatctctaattattattttgatatggtagttataactccaattagacatttaggcgcatgtataaattggccacttgaatatctagatttgctataattaactaattagaagattaactatactcaagtatattatattaaaaaaaaaaaggcttctaatttaaagcatatacaatctcaacctaaatcatgagataggaaattattatttccaacacatttaaaccccacacacaataaccaaccaaacaactacattttcaaagattttccacaatatgtaaattaaccgtgtagaaaattaagtccgaattatgttacctccacaaactagactgctccatggctcacaattgcattctttatgtttccaaagggatagaagcctctaaaaccatttgaagctttgtgtttgagaaaagagcgaacagttgtagagcgtgagaaagagatgcttccttgatctgtgtccctcaaggaatatgagtatgttggataaaccaatgaccatgatgaggatgaggatgaggaagatgagcgagatgatgttggtgacacatgagcctttcttgaccctataaactttggcataaaacatgaaaatatattggcctttgagtttcttctcttgtttttggacttcaaattggaacaatatgaaggtgggggtgtaaggggtggcagagaagtctcagaagaagggtgttttggggtgccaggttgtgcctcccacatgaaaggaactgcaattgatgtttctccataatagaagatccttgaagaagagttagccatggaggtttccttggacattagtcttgagaagaacctatcatcctcttttattctgaaggacttctcaattgagacatgattggcagcaccatcgttgagcattttggatattgaagtctatgattatttttttttatctcaactacgatctctataatatgcctcatacaacaaggtgtgtagtacactcttataattgctatctagactttagcattgttttaggacttccccgtacttaattctcttaagagttaaaacgaataaatataataaaggttgcatgttcttctaaaattactgaagaattgggttacttcgaatgggaattgatttaagcatagggatttaatcaaggagggcccgggctgttcgatcaatttaataattgggattttttggagggcaccaatttagttgtggcgagatttaatgcatgatatagatagttggtaattgaactatgaaattgaatgggttattagtggcagttgctcaattatttatggaagaatctggaccattgactaaagtagcgaaggtagttcctttataaacaattggtgctcagaaacggttgaggccagggaaggggaatttggttacgggggaacactgtaataaatgaaaacatgtcgtgatcatgaatgagaaaggagatttttgtagatatatatattacatactagtactgtataattgctttcctaaataaagagttattacctacctaattgaaataccatatgctagaaatctaatactcattcattattcgtgcacaatttaagtaacatcgatcaacagggttagtgtgaaaggtctcaaagtccattttcaacttgggaacatgagaagttctacatgatcaaggaatcgaattacatggcatactaataaggttggatccttaaaagagattaattaatttctcataatgtaccgaattagggtttgaattttttacaggagagatacctatattttatgcataaaagattgtctttaaaggaggatatttatgaagaagaaaaaagaaaaagaaaaacgaacccaatgacatcaaggacaccaaaattaatcaattcatgccacgtgaattattatctgattggcaacgtttatctcttctaaccaaataaatgaataaataaacccatctaattatctgttgctagtacaatttgttaggtatagtttgagaggcctgcattttgcacatgatcttctcctaccaaactttattttgtacccaagcttggatatattggatgctgaaagttcatcctcattaaatagcaggaagaaattaatgaatacgttgacctactcgggcatcgcggatagagacatatcagacagtacgtaacagtgtcaagggtattagcattatttattagccatgaaatgtcacatttgggatgagctgtgcgatcagaaaagtcctatgctttttcattggagaattgcacccacatgtggataccgttaactggatctttcctactcgttttgctcagtcttaagttctctcaacaaatttgattatttgatcaacccacccataccagcatcttttaaaaatggagtctaatttaagataaatatttctgcaccagatgaaaatttgttcattatcaaccatgcacctcactaattagatatgctgtgcgacgtgtaataaaataattaaaaaatggcccattaccataaagagaaattaccattatatatcacagcggtgaattatcaacagcatgcaggaccatgcatgcaatggtccagtactggaaaaagaatttgatgcaggagtttccgaaatctactgtgagtaagatacattgaatggtcaaataataacatattagacgacatcaagctaagcattaattatgtatctattaggacttaaatgtgttgttcactaaatctgaaagttatgattaattgacactgctccactcaaggatgccatgttgagatgcggaatatttacgttaggacctcttaatcatgtgtttctttctatatatattgcactttaaataacagaattcacttgttatattactgccattgctatgctgaggcggcagattcgttacgctccatgtgggtgctaaacaacttcattctgatatgaaatttgcttttgatttgttcatttatcacgaagaatgatctgaattagacattgcaacagaaaaagctgggattaggtttggagatattgaaaaaataagtatcgtatttgagagaataaattatccaagtatcacatttaacttttaaatataatattaattattttttttctatcaatatccctaataaatattattttaattttgattataatattaatattattctcttttaaaaggttagttttataaaaatatcaatctcttacatctatttattaatttttttatatgtgagatcaagaaaattaatgtggctagaacctactgttattctttttttaattaattcaatttattgatatatttttaaataaattatatatatatatatataaagatatgaaaaaatcttaaaaataaaaaaaaaatgaaaagctaaatcgtataaaaatatgttattacaactttattatttgactttattataattaaattattaattattacaataattaatttgtatatttggtaataatgaaaactctctgtatgagtaggaaagagtataaaaaaaagtctatttgtgtgtgcgtgacaaagaaagtataaaaacaaaattacatttatgtgtttgtaattgatgtgtaacattttataccatataggtttgtatgcattttgggtttattagtagttttatcattgttttcttagtttccctagtttaggtacttggaactcttgaggtgtatttttatatgtttgagggaggtttggccttggaacttaaggatctaggcttggagtgattcagaactaagagaaggacaattgggagcttggaaacttgaagaaaattggaggaatgacaaccaaaaggtgccacacccaaggtgtggcaagcatcatatcagaaagattacattggcaaccataacccacaacggctacggagtgagaatttccacggtcatggcatgctctaagacaacatgacattggttcaatattattacgatataatgagttgtaggtatcagaacaacgggagactaattcctaaattttaagcacaaaactatttacaaccttaatgacgaatttcatgtcttgattgtgattttggtcatgcaagtgaaacctgctacaacactctatttcgcatttggtttttgtattataattgtaatgggccttgaaccctttttggaccttaagtttgatagatattttagagcttgctttagtaattaagagtctccaactttaatcctagggaagaagtgacaacacaatgatcaagattgaaaataattcatatttgtgacttctctttaatttaatataattgagttctttctttaatttcaaattgattattttctcacttttgatattattaatttgaattccttttagaaaattgaattttgggttaggatatgtagttgcaaatcatttgttcttaatttagggataaaaatcttgaatatgtgatctgtatatgagttcttgaatttaaagtttattatgaattcaacttgtgtaagaaattagagttttggtcaaagataagactataagaggattctttatcatagggttgagattaatattaatctagttgtgtaaacataaatgtcaattgcctaagattaaaaaaattctaaattaattaagttgtattggagaagattaaaaaagtttcaagacaaatgctaatgatatattctctaatacattattggccaaaattaaataataaaatctattaaaaactatgaattttggtgaatttcataatacaagtattaataatagactctttctatcacaacaaaatcttttctacatgcatgaccaaaaaattaaactcctctcaacatacttaattaaggagttcaattatccttgccttttgtttttaaagacacgagtagttaataattttcccctttttttatttctttcttccctcttgtgtaaacaaaagaaagaagagacacgaatagcttattttattagtgtacacaatgctcgaataacattattcatttattctaaagtttaaggattcattaatcttcattaaataattttcgttctttttctttttgcttgaggcggcactctggcaattggcaaaggttgtaaagatcattgcagacccacccagccgtctccagacagcggcacgcagtaatacgtcgtcgtttccatgcataaaaatcgaaaacctaaaaaaatggttttgccttttttccctgaccactaatcacgccccaaatcatgacaaatcttttttttttttatttttttaatcatactattgatataatcatataaagttatgtttatcaaagacattaacagatcttcatcataatcataaatacagataaatgcattttttataataaaattaatttcatatttaaaaatcaattaaaatttgaattttaataatttaattaaaaaacagaaatactgaaaaactatatctgtgagagtgaagtcaaatacgtcgctacttattgtgtgaaccattttgggcaaatcacgacaaatcttacagaaaccacaatttcaccctcaccaaaaccatctgacgtggcaccacctcattggccacacttaaaaacacgtaaccacaacctttgacttttctccctcaccaaccaaccacgccatagcccacaccgtaactccacgtcaccatccccaccctatcatccacccccagaagcgctttccgccaccgctatcccccttttctttttttctcttttctgctttcccctttcgctcgtcgtgtggccccgcgacaccatcatcacgcacccttcctccttccttcatcctcggtattgcaataaatcacacaaatgggtgcttcaaaaaagtcaaagctcgaacctttatgttgctttagctctcgatgcttctctgaaacccgcgttcgcgtttctctttgcgccaatggccgagtcgtccccgccagaaacaccggaaccgaaaccccagttcggtaccggaaccgggtcgggtcaaaacctggaaatgaggagagtgggttcgagagctgaaattgatacttcgccgccgtttgggtccgtcaaggaagcggtgacccgttttgaaaaaaccggaccttgtatacctcttttcaattttggagaggcttatgtaaattttcatctctctgtgttttgtttctaattaattgttcaatttttaagttatgaatgtgtttcgtgtttctagtgttatctattatttaccttttacttgataattggttagatacatacaaacgttgaataaaaatgaattttcaagtaattgagcaatgccgcaattctgagaaggaacttgattactgagcggctttatttttaaaaaaagaaatatttttgcataagagctgcaaaaatgtttccttttctgagcctctcagactctccttgcattcagttcaaacatatgtagctcttgatttgtgaaattatgcccctgtggtgatttactctctgatgttgaagattgtttgttaacagaaaagtgctgaagactttgacataaagagagtggaggaggaagcggcgaagttggaaaaggatttgatagtgaaagaactcgaaacacttgacgtgcttgaagaactgggagctaccaaagcaattttggaggaattaaagcagcagctacaatcagaagcgttgaataattttgcaactccgggtgggaattcatgtgaacaggttggagctgctgttcaaaactgtttgaatggtatcaataatgaagaccagtcgttgcaatgtctgagtccgtgtgctacttcatcccctgatatgttcatgatggagttaagacaagctaaaataagccttggtaaaactataagtgatctcggggtgatacagtcttctattgaagctttgaataagaagatgaagaaggagaggctttttgttgagaggacacgtgagaagcttgcatcgaagtttgcaactgtatctgctcaagaagtggccaagaaagaaacaaggtttaatcctcctgaagctactgtaggaacaggttgcacttgtcattatcccctaaatgttgcgaggagtttcaaatttgatactggacagtgcaatctaatgagtgaaacaagaagctctgaagtttcaaggccattgcctgagtttggagagaatggatttagtatcaagactgctgagatgaggtggtttgcagctaagaagatggaagaagctgcaatggcagcagaagccgttgctcttgccgaaattgaggctctatgtagccccgagatatcatcggaattttctcctccacaacatcagaaagtgccatttgccttaggggagcgctctcctctgcaccccgtagttcaaattcctcaacagtcaaccttggagaaggtcatagattccaagtcccaagttgataaaataggttcttctaaactgagtattttgaaaatattggaggaagcaatagaagaagttacacgcagcaaacaagtcttaactgaggcattaaacagtgttgaaagtgcaaacagaaagcaacatgctgctgaagaggcacttcggagatggattcctcaggatgatctaagaggtccgccagtgtacaactatattaagcccaagaagttcaatcaagttggaaatggtcaagattctcctctaccagatttaaccaggtcgattacagtgaacaatgatcagaagccgatcttaaagtcttcagtttcaatgagagatgtacttagcaaaaagcaagttcctgaagaatatacaactaaggagatggaagagcactctgaaagaaaggtagcattgagtcaaatgcttcgagcattgaggcaggatcaaactctgcctacaataccagagaaagatgggagcaatcaaagacagttcatagcacagaggaaaaagtttggattcatccaaatatcactccccttgggaaagcgaagtaagaaaaaggcatgaatttagtcctattgcctatgcatggatcaatttccacaattcatgcatcagtgtcttgccattctttattgattcttatgttttgtctgcttttttgttaagtcatacagaatttatgactgattttgtaaaatacttatctagtgagataaggctattgttgtgattgtttggttttgtaaacttagtttttcctgtgtgattgctcactttatgcaactggcttagctttaacgggactagtagattttactgttgtgatatatatatatatatatatatatatatatatatatagtcacttacaatacactacacatgtcttgtattatcgggtaattttcaaggttctaccgttgacacggcgatggcgaaagtgagtgctctgttgcaaacaattggatttggttgttgatttcccttatctttcatttggccccaacaaccatttccacacccaaactttccaactccaaacatgtccatgttccgcttcatctccacaattgatgcagcatacgcggtaaaactggtcaacaactcgttgattctagaaaatattgagaggttgatgcacgaggaaacctcactacttcatttcattccaatctgctaagaatacatagaattagtccatatataggcaaagtaaacctaaataaggattaatcatcctaatttttctaattaaataaggatcatatctttctaattttcctaattagataaggattatatcttcccaattttccaaaattagaaacaacaaaatgtagaaaattcttaaaataaaacaataaatattcctagaattacataaaagatgtcattttaacccccaaagggatttggcaaaaatcttgtggcatgctctacatcatacgtaaagggcaaccttctcctatcacaatatcaaggacatcagatgtttggctgagttcggctattaactcattgtagaagcaacaaaataccatacataaggttttcaaatgaaagaactgaattgcctccattaaaaaatatttttagcttagttctgaaaattccgtcatacattgaaaattttaaaattttctattaaaatatattagattttaagttcatattaatttatttttgtttacgtataaatattttatattaaaatttaaattaacataaaattatcatgtaattattttttattttttggagagagaaaaaccccaacttgcacaaatcttctctgcacaaatccttcacagactgatgcatgtttcggatctacttcggactgtgaagttgtaaagataaaatttgtgagtatctttattcattttcttccaatccacatcatcaactatcctagctaatgagcttatcacacatactacatgttgtttataaaatataaccacacaactactcgaatttgttagtggcgaaaatgatatcaagtatatgattttacaagatgaaggattgagattcaatgcaaagttaaggacacagacaaattgtcgccaaactattatctcaaaatgatattatttagttgtaaaatattattaaacaataagagtttattttggtacatatttgctattggtaagattttgataattggtacaagcaaaggtcgaaggcatcaaatcattaacctgagcaaaatctgtcatctcaaatgcctatatctcaagaaagatagctcacttcaacccaaagagatatctttgccaaagagattgctgattccctttccaggatcactttgttttacaatagactccccaaccaatatctacaaaaaagaaaagagtaaaataatgagtctgataagagtaaaataatgtgaaacacctgttgattgttggtttactataagtgttggaaaatttgctaaatatgatcaacatgtaacaaatgttagatagttgtcataacctgagtaatccccttatctaacgaaattcaaccgttcttttactcaaactattattaaaattgcaataaacatgattgcaaggatatggtagcatatgatgagtaatttggctgacaccactatattttgtataatattttagtatctccaaaaaatcctgttagtaccttggttgcttttaaattttgttaaaaccgcatggccatgtcagattttatgtgaccgactcaaatacaagggatttagaattgtcattggagctgcttaggattaggaaaaaattgagtatttcaattaccatttaccaggtgtttacttagagtagaaatgaaatttaaagacttacagctttaacaccagcttcttgaacataggcaatatcgtcgggggtgaagagaccagattccccaaccatctaaacaaaccatataatcatcagcatgatgttgatattcaaaataaattaatatttctttcaagtagctctaaacaaaggaaaacccacatacaattatgcctctctcgtggattattttgcctcgctctccttcaagaagcttctttgtgatgctgatatccaactcaaatgtttctgcaatccccaaaaagaaaagccacaattgatgagtcatgagtcatgagtcaaatcctcaagtttaaatattcagacattggcacaaaacgtagaaaattattaatattctcaaactcgtgtgcgcatgagataggaggaaaaaaaggcccttaattgcactcttggtccctttactttggattatgcacaattttgctcccttaaatttttccagccaattaagtccttctaggagttatatcaatttccttacctaaaacccttaaattctaattttctagttgaaatattcacaaattgaattaattaatttttttaaaactttcttcaaatcaagataaaacattaaatttcacccaacatttaaaaaaaaaaaatcatttccccctctatttgaaccctaatttcacatcctacaaaatcctttaaagttcaactaaattttttacttttaaatatttaaaaatattttatattctaaatccatcctaaacccacaagtatttagaaaaatgagaatttgaaggtttttagatataagaaaattgacagatggacaaaatttgcttgattttaaaaatagaggaacttaatttgcttaaaaataacttcggggattaaaatcccacaaatttcaaactaaaaagaccaaatgtacaattaagcaaaaaaaaaatgttgctgagggaagcaatagcataaagtataacaaataaaaataattgtattacttcaaagttttatgagttctaagagattgttgtaataaggtacaaataggatttgagaattaatgaagaaactggaatatacagaaaatgaaagcaaaaatagaaataaaaggcacataaaattggagacgtactggaaaacatcataaagaaaaaagtggaaggggagacagagagaggagtgacaagacataccaagattacggttgttaatgccaataagctctatgccctctattgcaagaacacgatcaaattccctctcatcatgaacctgtgagtaaggaacataaaatgtaaaaaaaatctcatgttcatcaggaaataaaagactctgcatggtagacctagaattatggtttaagcacaaataaggaacataacatagagattcgtctagtcaatctaaagattctatacttttaaatctaacacacttcaattcttgctttcatgtacagaatcattatattaaagaggttctcagtttgtacattgcactattcaaaactcaaagtgacccactttaggaccaagtttacacaaaataggataaactcaaaacacagcgcaggactagattcatattaaacatcagatatcagtaaacttaaaaagatttgttaatgttgaagttgaatgtcattcaaatttaggaaacaaataaaaaaagcaccaatggtacctcaacaagtgcagtcattccgagtaatttgcatatcttaatcatgtatttgatgtcaagatcaggcaaaacagcagcaattaaaaggactgcatctgcacctttagttcgagcatagtagagttgccatgcatctatgatgaattctttgcacaacaaagggcactgcatattcacaaaacatttgatggtataataaatccaatatcagggactatgcaattcacaaaacaaacctttatgccagcctttcttattgcctcaagattttcaaagcttccctggaccaatatcaagttagagttaattttgttgcaatatcacctagtactgaatcagccaaatattatctagcagtacacatgtaacaaattccaggattgttggtttaccttaaaatacttttcatctgtcaaaacacttagacatgctgctccacctttctcataagccttagcaatttcaacctatcacagaaacctctaaaattgtggcttataccatgaagagaagaaaaatacaaactaacaacagtgtcaaataagttgcttgaagggcacgatatattgactgatacaacaaaactaagagaccaagatactcaatgagaaaacataacatattcctgactgatacaataaattcagagcaggtccttatttacagaagataaaatttaaaaactataggattgacttcataaatgcaataattgtaaaagcgaacagagagcctatgatagatttgagatgaagtaatttatgttgatgggcatgcatctcaaaggggtagaaaattaattcaaagaagcaaaaagcttaagatgcaaaggagaagaaattgataagcatcataaaacaatttaagacctatctctgcaaacatgactcagatcacgcacttattatataacaagtagattcaggaagccaaatgaaattgaatagactaactttaaccaactagatgcaatagggtgtcagtcaggaagccaaataaaattgaaattttttttttataagcaaagtaatttattgatataagaatgcttgcaatgagcacaagaggtgcccaaaacaggactcaatacaaaacatgatgctgcataatataaagctcaacagcaagctagcctaaaacagacagatattccccatcccacctataggctaaaacacagtccaatgaaagctatacaacctcacgagtaaaactcatgtgtcacaggaattattacgattaaaattagacacatctcacaatttgttgtgtagctataactataagtccacgtacttccacaccaagtcacatgacattaacagtacccatatagtgtttgttaaaatgccaatataagtaatcccactgacttgatattagaaactcatctgccaacacgttgacgctgcaatctgacattgagctacgctaactaccaatttccatctttccacaccagccatccaaatatttaagccttttttaaataaaaaacactcatctcattgaaacctcccaacaaccaatgcatttcatgacagataattctcccacctctgtgaacaacaacatcttcactccaaacaacgtccaaccatcaacagcttttacattctattaaccaacacacaatcccccctcaaaccccctaacagtcctaaaatgaaataaaattgtatagactaactctaaccaacaagatgaaatggggggtgtcagccagttcaaacatttcacagattattacatcagaaacacttcataaaattacaaataaagtagatagataacaattgtaatattctatccgtaaaaaagatgtgggaaaacaacgcaaacttactggatcaaagtcttctctcaagatacctctacttggtgacgccttcttcacttcagcaatcaaccctggaagtccagttcgttcgttggctgcctttagagcaccaataaaatccctagcaggaggtgcattttcgagagctttcttcagcacaccaaggggttttctttctttaagctgaaaatcacacagtccccaataatacattcaatcaatttggttgaaaaacaacatatatattaagaacaatagaacacaaagcaaatcaatcacaatacctgtgagacttctgtgtccttgttccacacaatctcttccaaaatgttccggggcgtattgccctcattctgcaaagggggtccagatggaggccttctccttattcttataccctggctagctgcaacctcattttggaacattcccacctcccactccttacttttcagaacctctgtcacagattcaccagatgtggctactacagctgaaccatcattggactccacctaatcaaaacgccacataatccaaaacccacatgaaaaatcaacaagcagttcctcatagcataaaattctgcattcatacacccccaattgaacccaaattatttggcctatttccattatcactgaaccccaacaactcccaaaacaaaaaccgagagacccatattaatccgtaagaagacacgataaaaggttgcaaaacgatacaaaatttgcaacaacaaaaaaaaaaaatctcacctgggcacgaacagaaaaggatgaaaaggagcttcttttatgaaaacttgcttgggatggaagaatagaggttctgggtctggaagagaggaatggggtggcctgaaagggagccttgagagaagccaaaccttccattgaagcagattgaagggaaaaaaaaaatggaagggattgcgcagcaacagaaaagaaagatgaaacggaaagtgaaaccagggtttaaaagaagaacacaccgtctaatcgtctatgttatagtactagcattgaattgaattggagaagaaaatcgtcgtagcgttcgacacgtgcgccgcgcattcaattccgacgccacggcgtgttcgtggtttttctggccccaagagagtgtaccggttgggattggattggcacatgtgaagagctaaaaatggcacaaaattaaaattgattttggtctgtgccttttttttctttttcaccgcgaagtatttaactatttatcgttttacagtatgactttgtctctcttgtatctaatgttttgctatgctggcttggatcaaccgaactttaagttattttaccttaataaaaggtcttagtttgaatcttggatatgcgtattttcattaaaattgattatttctacctatcatgtaaaatatgggtggacttttctagtttaatatattcatgcatacaattattttttatctagtgtggaagagacaataaatgtattaaataaaataattaatgttttcatttttataattaatgtttaatgcttttgtttttaggtgattttttgttacattagcatatttttgggtacacgtttttatgtgattaatactgcttaaaattaacattgcatatagaaaaatatgaattataatattattagctgtttcatataatgaaaaaggaaatgtcagattgttgcacaggttttataaaattgttttgtaagaattagtatgtacctttgaatggattttatttatttatttgactggacctttgaatggattattaatctatattattttaaccaatgaacatatattctatcaaattttctgatagtgttactttgtgagatgtgagttgatcatatctgacaaacaaaggtgacatttgtaaaattctaaattcctaatattattagtgttatacaatgagaagacaaaaataattatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttttattaatttattattattaatcttatacataagtaaagtataggttgcgagtgcggatatgaatatataaatacccaaccagtatgaaaatggagattaaaattactatccgcatagtataacaccaaataagatattattttaaagggattaaagtttctcatgttatatgagataagtttttctcctatacatcaaaattacatagttttggattaaattttttcttctttttaataaaaaaaatacaatcaaaacagatatttctctcacgcatgtctctcctcttgttgctaaataaaagataatgttccttgattttaggagatgttattgataaaatttgaatataaaattggaaactaacttatccttaacaacaaaataacaattttgacttatttaaattaaaattactttaacagtgtctcaaggcacggaaaatttaagaaacaaccgcactattttcctgttaaatattctagcatctccaaaaaatacagaaaaagaaagaggaaataaaaaaaaaatgttccatatgacataaccgcactacgacccctaatcttcgtaagctctaccataccattgcattattcccacactggtgctctgtagaacatttaatctgtatattgttgttgagatcttatcttgaaatactgttaaagtaattttaatttgaataagtcaaaattattattttgttgttaaggataagttagtttctgattttatattcaaattttattaataacatatcctaaaatcaaggaacattctctttttcagtaacaagaggagagacgtgagtgttttgattatgtttttttttattaaaaagaaaaaaaaaattaacccaaatctagtagttttagtatataggaaaaaaacttatctcatgtaacatgagaaactttaatccctattttaaaatacctctcggcttctcccttttctcctctccttctctcccttttcctcctttaaggttatttccctcccttactttgaatcaaacaatttttgtcacccttccctttatgagttgttagtgaaaattgtccctaataacatccaattttatcccgttgccaatagtgggactcgtaccacttacaaatgaatatttccaactaagactaaaaacaattcatttgcacttggtgcattttgtatgcttattatcattataacttgggtttgaattaaaatttcgggattactttttaagaatttgagtaacaaatcaaaccttttaaaatttgaaaaacaatttatttttaagaacttagagaaccaaattaaataatttaaaaattaaattgataattaagcacacacaaaaaaactttcaaactactgggtacaaatatgatacacctgaagtcaaactttgaattagtcaaaatcttttttcttaataaactagagaattaagataaaaaaaaaaggaccaaaataagtaaaccatcccataaagaccaggtgaggggcatcattgaaaattttatctgcagattcttgctaaatgaaataaaacattattctacaaaggagtgcaaaccccacccaccctatatcccttcaactatttttcttttgaaactttaaactcggattcagttcgacggctaataaacatccatcataaggaaattcgaaagcaaagttaacatagaatcaaacaaaactgcagtttcaacattgtttttcctccttatcctaaatcaaaacaatgtgtcaaggtctaacagaggataaataaaattgaattcgtgaggcgattgtagttcccttcatcctgcagagaaaacaaaggtttatttagttcattcattcagcacactttgatcaagacacaaattccatcaataacacagccaacatttcacaagtcacatcagacaaaatactaaataaaaagagcaatgaattactaacaaaaaccagattatctataaaagcttttcaaagaatttagaaattccataaaaatgtcctagacaaaactatcattatagaaagagtgccagccatttcaaaggctcccgataaacgtaatctcttacactgttacacaagtacctagagtagttcctccccaagatgattgaatatgaaatcatagcaccttattgtcatatatgttcgtttgaaaagaacagcagtagaattcatcttaagaaaaccattttataatgcaatcaatcaactcatctacttattggcatttcatacaaattctatgatttacattaaaagcaataccattcaaaataagcaaaatacaacatagaacataacagagtcagagaacagaaagtcacctgccaattaagactgggaattaacaataagcaagcattatgataagagaaaaattagcaaagttatacaccctaaaaaccaatagagtgatcataaagttcactgaaatatggtgcgcttgatttggcattcaatcacattcaacatcaatgcttcatgagacatagattcacgttgaacattcatcaggaagccagaatcaaagaaaacaaacatactcataaccgcataagaagaaagttaagctgagaatctaccatccattttcaccattccctctaaaggatgatctgataaggacgaaaacaacagacaaaatacaaattgatcttaatttgtacaacagtcagacaaacaaactttcttttctgtcgttaatcaaacaataatctcaagtctcaaccactccaatccatcacacttccttgacacaccataaaatgtattcaaacagatcacccttatttacttacttatttactttcaatttcactgtttataaaatattcaaacaagataatggtaattttattctgttctacattgatccattacacttcgcttattccatacggttcacacagcatttagatatccaatcaaagccatattcacttcacatcaagttgttaatgttacatgcaatcacgagaaaatgatgctaacagctgaaacaatacttcttcccaaccaatcaaccaaattagccattcaaatgatattttttttataaaaaaaatatgaacacacaaaaaaaaaatcgcaatctgtgatttgagcggataataaacagagagatccaagtaaacaaaaagaggaatacagaaaacaattaaaaaaaagaacatttttgggcgaagtaatataatttacctaaccagatccgacgatgatgttgttaattggaatgaaaataagcttcacgaagaaacccacgaaccccatcacaacgaaaccaattgcggtacgcatggcaaccttggagaattctaaaatacaaaaatgcattggaaaatcaggatctacagcacagagatttgaatcgaagtggaacggaagaaggagaattgggaattagggtttcacctttgcgatcgggtttgtggcagcgcttcacgagcctcacgctgtcctttgcgaattctcttaacggatcgaacacagaatcaatggcgtccattctctttcttttcctgtctcccgagcttggatttgagaattgaaatggtcaaatgggtgttgattttttgttgaaagagttttatttttatatgcgcggagatttttatccaatcacaaaacatgtgttgagtttattcatttagaaataattatagataaataatcattttcatcacgggcagaaagttgataaatttgttcttaaagatataaattcaaatttttatctcctaaactaaaaaaagagtgtgacaaattatgcattcatttattaacttccgttcattaccatccattacagataataaaagagcttaggtgacacgtttaggtacgaatttgttaggttatattcaaaatataatttaattttcatcttttttttaatcattgtagaatataatattacaataaacactttaaaaaaaagaaaacaaacaaaagttagaataaacataataataaatataatatttattaataagcataatatttatgttcatttgaaatttttattatgacaatattaagtaatgacaaaattaagttgagtcttattttttttgtaagtattaacttaatgactatgcatttttatttgttagaatctcatattttgggtaaggtgttgtctcatattttgggtaaggtgctgtcttatatttttgctttaaaatttctaatgtgaccatacattatccataatatgatactcaaacaaaaatgcataattattaaattaatttttaaataaaaaaatgagaccaacttgattttgtcactatctaatgttaacaatagactatgtttattaattaatattatgtttattattatatttgttctaacttatgtttattttcctaattttttaaatatttattgtaattttatgtttataatgattaaaaaaggaagaagatgaaaattaaattatattttggatagagcgctgaaaattcatctctaaatgtgtcatgtaggatcttttaattaacggtaataaacgaaagttaacggatgaatgaatttatcgcattttttcactttcgaagacaaaaatttgaatttccatcttttgatgataaatttgtcgacgctatacatattgaagaatgaaaatgattatttatctaataattattttaaaaattatataaaaatagtttataatttttattcattaataatataaaaaaattaagactaatttaatgataagaataaaatataataatgtgataaaataaaactataataagtttttatcatatatttgttattatatataagaaaaatagtatatgtatttttagtgtaaaatcttttgacattgatgtataataaaatttaatcatttaatcatataaaatgaataattaaaaaatcaatttaaattaaaaaaagttaactaacctctcaattttttagcactcttatctgtacaactcactgtctccaaatcctaaattccaatttttgagtcactttcctctattccactctctctgaaactaaagtcaacattttttcatgtcacccttcttaattactccactctcctctattcatctcatatttcaacccttcttttttatttttcctaactactcttcgttatcttatgtcaaaactcaaaatgctaactactatttttttttcttcaattaccctattctgcttcactccaccattattatcatatatatattttttttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttatctataatgatttgattttcatcgattttcttgattttttgaagttctcttcagtcatgtttacgaatggtagcttcaaatcggtggaatagattttcatcgaatatgttaattatttcgtttcatcgtcctgtgtgagaattagtgtgctccactttgattttatctataagtgagtccctattttattttctctttatgttgaaagttatactttaattaggaaatgggattatttcaattaatgtaattaatctaaattgttatttgattcaattaatctgaatggtacttgataatatattatgaggatatgattattataattaatgatacagcaacattatttcataaatttaaatttaattatattttgatatgagttttcacgtgatattcatgtattttgatatattttatttgataaaatttatgattttgtgtaagtttatgaaagacgtgtgtttaaatatttcacttaaaaaaaatctaaaatcatgccttttatgagataatgaagaccacgacgagcaattattttgtacatgagtgataattttatacatgtgttataatctatactatacaaagtaaaatgttttaaaaaatggaaatctccacgtgacatttctaaagcaactaaatatttggtaaaactaaaattttaaatttgaacataataatgaacttaggggtctgaacataataatgaactaattgataaaactaaaatcttaaatttctaaagcaacaagttttgagtcaaaatgaacttaagggtctaaaattagttttatatataagtccgatgactatggaatttatggacaattagactttagtaatacaaaactataggaaaggtttcttcccaaaaatcatcctatgcaaagagccatgtaatgtcaaagttggccccgttttatcatttcgagtcatttctaagataccttgaatgcataattttggctcttatcatcttgtcttggttttgctagctaacacttactaattggagtatcgtcggtaccaattcaaaacacattgaagctagtaataggaacctataatagtaattactattatgatttaaatatgatttctgttttccttttactattatgaactaggacatgaaagaaaagaaatcaagcacacatgaaactgtagacacgtttaataatttattatcaagaaaactgtacctgatatgaatctggaaattttttatttgagagggttttacctttgaaatccagtccaagcctcaatgccaagcaaagaaaataaaggtccttgcatgaatgaagagtaaaaacatagaagtttaaagaagatcgtgattaactaaaagccagaagtgcaaagtcatagagaactagctaataccaaatacccgaattctcaatggaaaactctaacatttcaaagcataaaaatgcaatttcttctagagaataacacaaaaaaactgaactttctagcaatgtgttgcatacctcccgcaagattgcaaagtttgcaacaaacaaaaggtttctctagggaactccatgcgtgatgatgtcttttgggtgtgagattgacaaaacaaggtgaagataacgacacaatcacaaaatgaagaggttgtgacggagaaatagggacgcacatgagggtttacgggagaaacagggaggtcacgagggtttacgagagagacagtttcagtctcgtacgacagcagccgcgtcggaataagggattaggtgcgacggagaagcaaagccaacaagttgcagtgacgtagacgtaggggaaaagggtttggagttcagggacgatgagaacataaggagcaaacagaaggaatgaacgcgaaaagcatttggtaaaacaaatatagcgtgatttgcaaaaatgttgtacttatataaagttactacaacgctttttctaacaagcgaggtaactttttctttttctttttataaaaacatatgcaacatttaaaatatcgatctaaaaatccgttgtatataaaaacatataaaaacctatacaatgtcaatctaaaaaaccgttgtagatgctggtccactctacaatgctttttttggcaaagcaagatatacatgttccgtgtcaatacatacaacattttttcataaaatgcggtataattggcgctataaattagaaaatctgacaataaatctatcgtatttttcatctcaaaacctcaaccaatctatagttgtaaaattcgatccgatcattggtccgatcgagtcaatgatccaatcgatgagtcattaattaatctgatttgactcgatatatattaaaaattaaaaattatatgtatctattatatataagtatataatattatttgagtaagaaaagttcatccatactccaaaattcaaaataacaattgataataattcaaaatccaaaatctaaaatttaaaaaaaaatctatttttttaaaaaaaatccattttttaaaaaattaaataaataaaatcagcagagttggactggtccaatcgggatccagtaacctaaccagtcaggtttgatcggatcatcttggatcaactatataaacaatccaatagtaaaaccaacccaaataaatcaccaagttcaatcagtctgaccaactaaatcagatcgaatttcacaacactatctcaatccttatttttcttagccaccatcctcttcctcacttccctgtctcaaaaccctacctcttattattattatttttacaaagtatgtgtttgatatttgtacttttgatctatgtaatttaaaatccatcaatatgattcccatcggaatcagggaaggcggattccatagttgcctcacaacctgcccattcgagaacatcttctcgatattttaaaaaacaagtgaatttaattcttatttagttgtcaacaacaaaaaattcctattttgtcctccaagttgtcaatgcataaggactaaatatacatataaaaaccaaatcaattatttaaaattaaagaaattaaaatcaaatttaatatctaaaaacatatttttttcctgccacttacactcctctcatcccatctcataagttataggccatgtttggatataagcttctctagaagcacttttagaataagaaagtaagaagaaaaaaatgaaataagttttttcataagataaaataagttttctattagctcatttgtagatgtcatctcatattttagaaaaactatattagtgagcttctaaaaattagttaattaagagtttatttttgcttatgaaaaaactcatctcatttttttcttcttattttattttttaaaaatacttctaaagaaacttaccactcgtatcctcaactccttactttttccagccactttccaccgcctcattctctcatccaaaatctcaaccttttcaggtatgctctcctccttttccatcttaaaaccttaacttccatttttcctagacatcctttctacccaactcctcttttttttcaaaattcaaatcccccatcttttttttttttcatcttacgctgtcccacttttccatctccaagctcaatttcttatttataggtttttatttttaaaattaatataatctaatgtagtaaaataaaaaaatttaaccgattttcagtttaaaacaattttacaaccatagtgtataactctttaactctgtaaagaatatataattaaattgtcatatattatatataaatgttatatacagtaagagaaagacatattttgtaattttttatatattattttaaaataaaatataaaataaaagaggaaagaagaaggggaaattgaatagaaaataaaagtattaattaattttataaagttatagggcaatttaataaaaataagtgaaaactaattttttttatcatcttaatatatatatatatatatgtatgtgtgtgtgagagagacatattttataagagaaaatatttcacatgattgtgaaatgattaaatctgaaccatataattatatatagagaattaagatgtagtgtcaaaaaattacatgagtttttaagtgaccacatgatattaaatcttgatcgtccatgttaatttgattattcagttcaaatttaatcatctcaccctcatataagatatcttcctctaatatgatacgtcatctctctctcaattatcttgaatctcaaaaaatgaaatgcttgattatcttaataaaaatagggatcaaaattgaagataaaaaaataaagaaatcaaagttataatttagtctattatttaatatttaatgttcattaagaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatttaggattggataatattttaatttttttgggtaaatcttttcgaatcattaaattgtcttataagtaggactgctcaaaattaaactttattaaacacaatttaaataaagatttgataataaccttttaacacttagaaaaacttttttttatatatcaaacaatttttttatgaaaacctcaattaaatttgtaaaagagataatgaaaaagataacaacacaatttttttacattgatttgttttaattcaagaatacatttaatttttggtatatttccactaactcaaacattttgcaagtatttattttgccaatgcctcttcagactcaacatgagtattcctttactttcttctccaagtaactcaccatgttaactttcttagagaacctcctgaggcttcaaccattttcacttagaaaaggttagggataaaaactcattgactatattgtcttaattatatagacaaatgtacaatttacgctctagtctgtctaagacgattagctagaacatatctccttttgagttttgagccgacaattatactatcatactcttaggataggtaaacacgtgtctattgatctagataatgagttatcttcgtttgattttcacaattcttccttgatacacttatggtaaacatttgcatgaaaggccaaaattaaaaaacttagagaaattattgtcttacttgatatcgatatataagtcatctgtataaaggttcttttaaagtctaattgctatatactcaagaatagaaaacatgtttcttcacatcacaatgtgtccacatatactcacatctaagatgtgtgacagaatcataaatgcaggtgtaaagaaaacgaaattctaaattatatatagacatgcatgagaacaaagaagttatgtgagtttttactaaaaaaacattattacttacttgaagggattaatatgtgatagtcgacttaaaaaatatctttagtatacacaaaataaagaagcttgattacttataaaagcatgactaattaacttgaaatccaatattaattatatcagatcctctatcaaattaaaatatttttatgctaataaaaatacactatcataagaatacatgttgcaacttgcaacaaatcgttaatgaacctagctagctagctaatatccatagtcaagcttgtgatgcattaatgtctcatttctacccgtggattttgactttactgcttcttttaaaagagtagcatttgaaagaggggagaaattgtgatggtcacgttgtcaaatttcacagcagccgcaacacaaccaacctggggcaaactcgttgattttcatcactattcactcttctttctcagtctagtttgaaccagtcaaacttgtccaagaaaaaggcatccaagaaaaccctccttttggattcaacaaaacaaagatcaagtcaattacctctgcattcaagaaacaagcatacacgtgcacacagtcagagagacatatagggacaaaattgttaaatccctgtgtgaaaaggatggaacacaatgtcaaaatttaacaaaaccccgtttgacaagctttaatcgcgtacagaattccaggcatttctgtcgttcaatgtctcttgttcccaatctcaaaaaactcaaaaactcaaaaagtttaacaaaagccagtctagcaaatgacatgtacatgacataacatttcaatctcgtgttcgtgtaggttattatatatgcaaactgtgatggttgtattcaattcaccccataaaatgccatctgagtctctattcatgaaaatgatgaattcatttctatacatatttttaatttaatttgatcaaaatacatcgacatttacatcattgtttaatcatagtataatatactagtattgcatgacaaaattattgattcatgtaataattattttaaaagttagacttacatagtttttaattagtttaaaatctaaaaatctttgcaccaataatatatcaattttttccatgtaaatacacatctttttattttaatacacttatttaaaaatgttatatcaaagttaatttatatttttgtacttaattaaaggaacctttttcttaatttctttaatcaatattcaaattttcaattagacaatagtgatgagccaatgacttatttattttccttcaaaattttcaccattagacataaaaatatattttttaaattacaattaaaataatcttatatcaaatcaaaataatttaaactgaaatgtcaaataaatgtattttaatatctcaatttatattttacataataaaaaagttctatcaatcaaatcaatattaccttacatatttttaaattgatttatttttacatttattatattcatatctatccatgcaatggaccagatatttgcaagttgtgttatatataaatgaatattcgttcaaacaaaccagctacaacggtgatttttttttttatatagttaatcccattctgacaatgagttgataaatgctctaagttgattaaaattgaattttttaaaagagaaattaaaattaaagaaaagaaaagaaaagaaaagaattgtgcaataactagagacaattatctgaattaagaatatcaacagggaaaatgaaagtcaacaacttcctcgggcgtaatgtctgccgtataattctgaaaaggattaattagctcttccataccttctaccaagaacaataatttatacttctatgcatcaaaaatctaaaagtatagtgcagcatttattactaatttttaaataaaaaatgatttcaacgaaattgatatgaaaattgagaggagtgttatatataaccttgcaccatgatgattatatgtgtaaacagagaaggttaagacaataataaagtagcttgttattttcttaccgattttaattatttaaaatgtattgataatggaaatgatttttatactgtaatttaattacaaattattatgaataataaaattattatttttataattgttttagaagtcatatataatttctaattaattgactatgtaaaattgtttaaattgatacgatatgaaaattaaattcttccattatttaaaaaatatttttattttagtatttagctattttcttgaaaaaggggaggggaatgaacaaattttatagtaatatcttgtttaattcaaacttttagggagagatctttaatggtagatctcaaattgagatcttaaatcactttttggtggacctgtagtaccatgtaggattgaaaatctctcaagatctttctatcttttttaatggtagatctcatattgaaatcttaaagagaaagaaaaaaggaaaaaaattattcttttttgaacaatgtgaagatcctaaggaatcttttacaagaactcattctccatgttggaaatctcttcatctcccttattgagagatctagtgaaaatcagatcttaagctcaagatctagcactaaaaaaacccctttctgcattacatatggcattgacgccatgatccccgttgagctagaggaaccttcaacaaaaaagatgctcttttcaggaatagtgcaatgaggaaaacatgagagtcgagttggacaccaatgaaaagattcgagacatagccagaattaatgaagaagtggccaagctccgcagcacaagaagatacaattctaaagttcaatttcgaactttccagccaggcgatctagtctggcgtgtccggggtgaagtcaggaaggatcaccgtgcaggtaagcttggaccaaactgggaaggtccgtttagaatcattatcaacctgaacaatgatgcctacaaactgcaggaactcagtgataaagacattccaagaacttggaatactactcacttgaaattctacttcagctaaggagttgaagaccggatgacgtactatttttcctattcaagtcttttgtcccattggattttggtttgaaagattttaaccatgctcatccgaggaataacatatataactatatctgatttaatttttttcctttcaattttttgctttttaaaaaattaatttttttaaaacaaatttcaaaatttgatagatcatatttaaaaaattaactgatgaatagtataaaattattttccgaaacagtttttaaaatgaaaaagtgaaaagtgaataaaacagaacctaaaacatcccttctgccttctcacaattttgtcttctaatattaggaaatttgaaagaaagtaaaacggagtttaaaaaaattgaattattttttttggttgcaattttttaaaaagtatattaacaatctgaccattttcatgtattgccatttactcatttagattcttatttattatcataagagtataataatacgttaatttcattgtttttttctcatcctctttaattttgtcttcgtcctcttgactaaatagaaaagaaggatttatatttttattttcctatcctgtttgatcgtctctcctctgttaaaatctttggtatccctttacttccaaaccacataacatatatatagtctttccagggctgttaagatggtagtaagacgcatctataaatatgaatataatgaaagatgaagatccaatatttaaaagaaaatatgtttggtaacgggaacgtagtggttccgacgtcaaatatcaaagatgtagccccaccaaattttataatgaggcagcatgaactttaatccttttagatttatatgtaataatcattgagtattctagtttcttattcccgtgtcaaatcctcaggtttaatcactgtaccgcatataattaagtatctatctatctatctctatatatatatatatatatatatatatatgtgtgtgtgtgtgtgtgtgtgaaattaatcttttgagtcgtacgaaatggttaaatcaaacgaaatggttaaatcaaactctattcatgtgaacaatttaataacttaattactcaagtccataatatttcaattataagtaaaattaattggaacattgatacttttattgcaactaaatatgattggattgctgatgtttgctcagggaattatatatcaatacctttttttacaagttacagttaccacattttgtcaatttcacatcaattgagattttgtttgactacttttctatttttttctttctttctaatattctataaaattattagtaaatattgaataaaaattaaatatattaactatcttaaaaacataaacaagttcaacttttatatattatttagtaaagaagagataatttgtaggaggatgttataaaaaataaatttttatatttttaatataaatagattataattgacactataattccttagccagtagaaaatttcctttttttctttcaagtcaattttagtgtcaattttgaaggttttctctaaaggaaacttaagggtacatttcatatggaagatttcacaaggtaaattatttgttcacattagctttaaaatacaaatgtattttttttataatttattttatgcttataattttgaaattgatttacatattttttttattatgattatttttagtttggtcattcaactttttatttattttacttatcataaaactaattttttaaaacaggctttactgttcacttttttatgactaaccattaagttatacatgttatagattggaatcttatgatttggtatactaaatttttttgttgacttaaaatagaccaactttatcatcacttgatagtcgcatgtcatgtcagctacaactataagataataatgtgtggcagatgattagatgcatgccatattcatgattgttttagaaatttaaacatttcataatatccaaatccattaaaaaattaggaaattaaaatcaaattaaattacatttataagattaaaaatatattttatctttttgaatttctatcattacaagagaaactattgatttcttattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattactttaccaattaaaatttagctctttcaatggttaggcttctccatcttcgctaatctttttatccaaaacaggaagacaaaaattagataatatataaacttaacataattcattttgtaataattaatttgagcactaggtaagattatcaaggagttcttattataaaaaggtagtaaggaggaaaagatgtccctagctagtttatatcaaatttgcatgcattaattcgggatttaggtgtcagatagaaaagtcatatacaaatctgagaatcaaacaaataataatgagtttatatcagatttaccgcaagatgatttaattaattaattgatttaatttgactatcaaattaacacttactcatatattggtgcatttaggagcatgaattcttataagaattagcataaaatctgaataatcaacgcatatgcacatctataattactacaccgactagtggtctatcccataggttaaatcgtcttttccttgatacacaacatgcaaagtatagttaggtgggtttttgaattatcgaaatatgagaaatgagtgtcaaatgatttcccgtgttaccgacaaactaatgctagcaaaattaggcagcgaatcatgaaaacgaagtttaggcttttagcagaaactgttacgtttcaccactttctaattatatagattttcccccaaatacaggcttgcaaatgagtcagaacattatccttatattaaagcatgcatttgtgatctccgaacaaaagaaattgattaacatagagagagaaaaaaactcatccatcttaattcccaccattcaaatctgaaacgacagaaataatttggttcctttatgcctaatcaatactagtaatttggacacaagaaataagagagagaaagagagagcaacatgcaaatgaagagggacttggaaaaccagccacaaattttatttcactgtttttaatttgacgaccattgatgtcctaaaaccgtttacaaatgtcttctagctgtaactatctctattctctaagacttactgaaccgacaaaaatataacaagagtgaaaatataagtgatatcatcaattgcaacttgcaacacacataaatattattactattatagaaattaaaattaaagaacaagttgatgaataaatgcctggctttcccatgtacgcctaatcttcctccactggtgaattctccaccagtaacaacgagatcctcgtcctcaaaatcatatcttatacccatggtgaggttgaaaatgaatctccactgaccccacatgagttgcaatggcatttttctcaccactagtgccatccatgaacctcttcttctttttcttgttcttgttcatgactatgcagcagattgatgccttaaagaactaaaaccataatatatatttgtatctagctaggatatggaaatggaaagagtaattaagaatactaattaaaagggtatcactttgtttaataacagagagtgagagagaagagatagagagaaaagggagaggtagaaggagaaggttgttcccaagaagatgacgagcatttcccgttgatgttgttttcaaagagtgttttaatttccttagggtgggccaggaaagaaggcatttttgtttcacacgttggggtggttctctttgtcttccccgcaaacaacagtcaatggttttaggcttaaccctcaatgaatgaatgaccgaatccactttatttatttattctcaccttgtcttcctccgtttctttaattaggtttcctttcttttccttctgcctctcctctccctatgcgttactagctgtatagcttcagctgctagggaacaatgtacatccaaaaaggtgtattaatatagactaaccagagtgtacatttctagtaataacttatgagatatttatatcatctgatcataagaaaaatataattttaaagaattttttttttgaataataattatatttttaaaccaatatttgaataataattataatttcaaaaatcttatataatttcccttaaaaaatcgtatattatttttttaaaaaacacataaatataaaataattttatataagaaaataatgttatctgatttgatatctaacctataccaaaagcttaatatatttttatcgtatcatactcttgacctgcatttatttttatcttattacatcatatatcataatcaccaaatgagcttttatactaatagcacttaaactttaaagtaattaatatacacacacatttactaacatatatagcatcttattttttaaaataaacatttaaacaaattataccttaaatgtttttgaaaataattaaaaaaaagagtagattctactaactactctagagactttgcgaaattacacattttttttaacatttaccgtattatgtcttataggagaatagatgtgatgtttttcaaataattaaagaagttaatgtaatatataacatgacataagtgtatatttgtcaataattaaagaggttagtgtaggacaatcggagtacataaaaacacggagagtttatttaattacacaaaattttaagaatagttagtataatttattctaattaaaattataacttagtaaataatttattttcttaaaaaaagagagagactgtgttaacaaattaatattgctatatacatttgatagtatgtatgacacttgtctctatatccgttatattaatttgcacttacttgtctctccatttatggctatacttatatagcaattcagtgtaaaatatggaatttggagtggtagatgtttaatcaactcgagtataatcttgttgaatgtaagtactcgataggggactagcagattcgatcttttcgcgtgttgtttgaagcttgcaaatgtcaataattgagcaaaataatgtgtgactgatagttcactgcatttgataccattacattcgagtgatgccattgctatcaattttgatgtgattgtgctatcattttatatgcatgaaaaaagttctatataaacatggtgtgaatcgatctgtgagatttcttttaacttctttttaaaccaaaattgctgtatggtgatagatacaatatgtaaagttcaacacataaataatgtgttttgattgataaatattctccaacaatagtttatttgccaatacttgtgatgactttaaaagtgagactgtatagtaaatagtaaggagtcccgtacgtgctaagcacgagttgtgtcaatttcaatgtttaaatatacattaatatataaatacacatgctatttttaagtaattatgtgatggaagatataaggtttatcaaactgattgtgaaagagtaaaagaagctggttagaatttctgcaattgatatttgtgacaaaattaacaaactaacatttatctataaaaataataattatgtgactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagatcaaattacattagtataattttaataattattatatcattttataatttgatataaaatattatttttattgatctaaccgctaaactatatctatatattataaagatcaaataaatatgttaaattttattaaaattgaacaaaaataagaaaataatcaaatgatctttattttagtatattttgaaatgtttatattacatcaattttaatatatatgaacgagataacaaataatctctcctcacatatatatagatatataaactcttagtgataacatttgtttattatgagaaatgagatcactaattaataataatctttggattaatattaaaaataatagatcgctcatgttaaaattcaattgtagtaatatcttgtgagatcactaattaatgttaccagcactactcatattgtcactgttgtcaacttgtattcgctgccaaaatgaaaactataggatttattatttttaatattcatctaagggttattatatataaaatatattaaataagaattattattattgtagaaaatgaaaactataaatttagacaataagattttggagatattttgaaatatacaaagttcatgattatactctttggtttgtaggcagggatggatcctaaaaggttttgaaggggggacattttttaatatatgtatatatattgtgttttgattataaaaataattcgtcagtaagtgttaacaatctgaatctatatttaacataatctattaatggtattggatcctattttgcaaaattttaattgtagtatagccatttaatttataccatcagatcctagctactctgcaaaatcttaaccatatcgtcatttgcaccatatgaaaaagatcatacgagagggggaaggggaaggattcctgcctactccccttggatccgtctctggttataggattctagtgatacctctgtagttaacgggggagtcttcttataaaggaattattaaacacttatgtaagtagtaattttgttatagttataattaaaggtaaaatctcgtacttgtgaagaaaaagttgtatgatgattttaagttgatggctttgagatggaagcaatgatgattttgatgatcaacctcacagtcgatatgatggctagttatattattcaatttaataatatgaatgcatgctaactaacttcaattagtaaaaaaaacaaataaaacattattaaaaaatatttatataaattaatagttaaataactttaaaacaatacatgacaacctgtgcgcacagataccttgctacttaacctttataaattgacacaagaccagtaataaggcaaaaatctcagggagttcttcctttgcattcctaatcccttatcctaattaacaatgcatacctatgtgatgcacccaatatacgtaggacttccacttttccaaacaaatcaccataaacatgttaattgccaattttaaacattagcaaaaaagttattatagaaccaaatatttaatatttttttagaaaagcattatgattatattattatattatagcataatatattaacaacaaactcaaaataaaaatgctaagaaaaaataatcgttaaataatcattataggattctagctgttgaaccaaaagataaatcaatggcttgaatgttcttaaaagaaactgaaaaagtattatataaaatgttgacacttggcatcgagggaagacttttataataataaatatattttacaaaataagcgatatttttataattaaaataatcttttttttttcaaaccaaacaactttacaaactaaaccgtaaagccaatcatttttcggactttacatgacaaaccaccgtcatccaaagtgtttgtttttttggtcgatggtcgaaaccattatccaaagtccaaacaatctataatgttgcaaattgggtccattgcggaccagtcgacgtccacggctcaaatttggtccattgcttatactaaaatccctattttcacggaaaacgtttccagaataggttcagcaatgtctcgtggaccatattttggctgaacagtgatatatagatatagatacatagatataaattacacaatcctcacccatcaccccaatttatttgcagatagtagctagcacatatataaggttgcaaatcagtcccacttggagtaaatcaattaagattaaaaattttgaaaatattttaccaaatttttttaggaaaatatttttattaatatatttatgcaattttttttattaacataggaacaatgataatttttaatataatttattcacgctctcaaaatttttacaaaacgtttaaggaaaaataaaataaaataaagcgtgagacatgaaagagagaaagtcacaataagaaaagtaagtctgttcttcctgtttctcctacttattcatcactttctagatttccgtcttaatttctaggcgatcgataatcatactcttgttcaagagtatgtcatgtgatctctccttcgtgaccattagtcaacaaagaaaagatgtgttcgtggaaaaaggaaggaagacttcaattaattacaaatttcaagctagaattaatacatatgttgtagctggggtaataactagataaagatctaaacatgaagttacagtacgtagtaacaaataagtcataaacaaaagcatagctcattcaatctacacaactagtacatgaagttgattcatttcatttctttccaaagctgaaaatttgctcttcagtaacccaacatatatgctgagccgagggaaaatcaattcagaatacaagtgcaaagctaagcaatatgacaatcattccctatatttgtgtaaaagtaaagtaacctactagttataactcactagaccccactccaaaagaaaattaatcttttaaccatgtcttacctactctctaatttgtgaaaaattattacatggtccagatcattgcatattgatgatgacctagatcaatcttcgcgtgacatatgcatgtgtcacaaggagattgcttcttacacaaaatggtcttggatcatgtaataattttttgtatatgatttttcaccaattaagagaggttcacactcaatagcttgcaactccttcatgagcatcatcaccttatctagtagccaaaggaaaccaacgttggtggaaggaagattggtatgccatcatgaacaacacgaagagaagcaagagtgccactccccacggagaccctccagctctgtgcagcgactccctctcctccggcaagggtattgggaacgacgctccgctcgagaggcagtgaaggaggagcaacaagagcagcggcacgagggcgaggaagatcttaacctgcacgagcaagtcctcgagcaaggactcgtagtttatgtaccacgagaacgctagcacgaagaaaaggatgaacacgaagaagacgaggtggagtgggaaagacaagtaatcccacaagtagtagtagggatcgtggtacctggccatgttaagggaaaataaaatatagtgatgatgttagtgagaaatggttgagaatgaatgaataaatgagattttgtttggtagaaggaaggtgtttcagatattgtgtggagtcttctaggggctttgatttgaatagacagttgggtcaaaaaggtttatataagcagttggactactatggactacatccatgattatttctttggcactaaaattagaagagattggtctcttttatcttgcaatttttattgcaaaaaattgtatgatatctatttctttgaatgtatatagtcctttagaaagagaataataagaagagaaaatgggtggtacgaagaactaacataagaaacagacaaaagaaatgtgataaatcttataataagaattattttctctctctagatagtctttaaagtgttgagagtatacaaatttttaaagtattgaatattcattgatttaagtgttagatgcattaatgtatattgcttacatttagcgactaatttgaaggatttttttttagaacttgagagattatttagtaagatttttgcttcttgcggaaggattaattatataatttgcttaatttaaggattatttagacgagaataatatatactttaaggatgaaatagataatttattacaaaaattcatgttatcttataagaaaatttattttgtttataaataatggagaaaatgtaaaaatttataaaatataaaatggtaacaagaaaatgggaatgaaaataaaaattgaatcctatttttttatgtcacatgatgtgattaatttttaattttgtcttataaatataaagtcacaatctcactagttaagtttttaggtctagttattacttgaaaacaggagtctagtcgtttcgttggcgtccgacatcgaatagaaccaaaaaagtaaaaagaaaaaggagaaggaaaagaaagtttaaatatgtttttagattgtgtacctataaatatttttttatattttattcattttgattcatataaatcttataattcttaaaatagtttttatcatttaatgaaaagataatatacatttaaatatattatattcgtaattattttgaggtgacgtgtgtgtaggtgacatcataaatagtaagtactaattttttttttttataaactataaaatttataagaattaaaattaaaaaataaagtcaaatttcactgtatttaacaaaagaaaaacatacgtatactagtatattataacaaagtgaaattcctgtccattttggcatggcttctactgcttcaagagaaagtagagattctactttttctattctgatgagtagtgacgcatcgagattatcccagtgacggtgagagtgagaataattcatggttgagattcaaaatggtgtcatccaataggtgagtgccagatactttggacactggaccagaacgtgtgaacatgagaaaaatcaaggaagttaaattatttttagaagccatgcactgtagtttgtgataaattggagacaaagtggggtcatagcattgggaaaactgcatcttgcttattggagggtggcccataattctgttttcaagctttattcgtagggtttggcgagccatgtccgttcagagtatcttatcagataaaattaggtggatttgcatattcctatgaaaaaataaatgatattggtaaacctcgctaagtatagtatatactacactcaatgatatatagaagagaaaataaaataaataaaagataaatattatataagaatatataaatatcattattgatcgattcctgttatccatcaaatccatgcatgctccatcatgcgttgttcctccgttcctttactgcagcttactttctttagttcttgaaatattctcttaccaataatattaataatgcagagcattgaatctacgattttgttttggtacgttggaccactgtagtttaaatccaagcatcataataaaaggatatatatatatatatatatatatatatatatatgatgaataaatccagttgcacgtatggagcaaacctggtcggagctaggctctcgtttcattcatttaattggtactcaacatgaacaatagggtaataacaagtttaaaatatttcatgaaaaacaagtttgaaatatttgaaataattatttataatataaataaggtttaattatgtttttaattctttaaatgagaaagtctatctttttagtactttaaataaaaattgatatttttcaatcactctaatttgaaacatgttcattttagtccatctaatttgaaaaacaccctttttagttcatctttaaaattggaaagactaaaaaatgcatttttttttaagaaatagactaaaaaaaatatttttgaatttgagaaactaaaaaaatacatttttatttgagagactaaaaaaataaatctccttatttgaggtactaaaaacataattaattttagaaaataaagttatgaaataatgagttttaataatttaatcagtcacaagggcaatgcacaacacatacataaactttaggttgaaaaatataattttataacagtgtgtttaatagcacaataaaataatttattatatcaaaataaatcaatgatataggaattggtcgcaatcctcttacaaaatgacaagatatccttccctcaaaacaccccttgttatttatagaaaaaaagccttaaccaaattaaactatctcacatgactaacttactcactaatataactaacagataggtaactactaatggggagtacgtaacacttatgttctcgacttttttcaccaaacacaaaacaatttattcaaaaggtgtagtatgagaataatttttatggcttctgacgcttgtttgatatgtagcggaaggagttatcccgagtgacgcatcaaagtgatagttatttttaactttctacatcatttatgtgttatagaaaatagttttttacatcgattatactcatatcaatgtaaaaagtatttattgtattcaaaattgatcctattagaatctctcaaatctttctcattcttgctaagatctttatttgataccctttttgtgttctttacttctgttgttctgtgtgattcaactcttatttaagcaaatatgtttgcagatcatgatttttccaacaaaatttaatttgatgattgattaagcttcttgatatatgaactaattaacattgtatgcatatattttgtgctatatgttttggaaaaatggcatgttatttacttcacaattaattcttatttgagaataagatgtgactgtaggccaatagagaattggataatactataaaagtcagtctttactggcctattggtgttgatttctttgactcaaatatatcagagttacttttgttgtcattatttataattgtctttactttgtttggtgtagagtgcccttccccagaactgagagaagtggtcaagtaaacctaacattgcgggagtggtatcgacttaaacaattcagggaggtatgttggataaattgattttttgtagttgtaaattttgatgtcaatctgtcttaatattgtgaattttatttcccagtgttgttgaagaaaagaaaaatctaattcttacggttccagatggatgtgggcgagagtatatattcacccttaaggtgattcatttattatatttttaagcgaatgagaattaaattcaagtagtactactatttctaaaatgccttattaattgtgggccatataaattctgattgttttctcaaatatcaggctgagacatcagaagacctgtttgaatgaaagacaactcttgaacaagccctcgcacaagcaccaagtgctacccttttttatgggacgcaatgggattttccggaatgacgcaagtgatcattctaattctattaagatatcgaagggtctttccatcaatgtatgtgtccacattttcgctaaattttgtgttgtgcttccaaggagggacaagcgtccaattaattctgtaagtctgtgattgttcaaataccaattctgctagcacttgaagatattgatggaggcatgtctttcggtctttccttaaaaaagctctttgatttatacttgctagagaagtatggtaagttatgatcttctattgcatatatgtaatgcatctgcatttcctttcacttcttaagtgtccgtgatgaaattttagaagttatatatctaagattcaaattcgatatcactaaatcttgagtaagttgattcatgtacttagtggtaattaaattattgacaagtttaatattaataattacattgacttagtttcttaattattaattaaaagagtatagaagagcagagggtagaattatatatactgtatagtaaaaagatgtgtcacctacatgcctggttggcggaaagccagccctagcacggatagagtccatgcttttatttcttatttcttacatatgtactagttattacatggagtacacacaagtatatgtgtgtttagttcatatatttgtgaattttacttcagcaacatttgcagccctttcgaccgcagcatttgcatcctccgccatgtcctccgccatgtccccagcctccaccgtgtccccatcttccaccatgtccccagcttccaccatgtcccccatttccacctcttccccaggcatctggctgtgtctttggttcttctgctgcacaggaatagacaaacatttttaaatattgcactgattggttaatttatttctttttcttttttcaaaagttacatttacatgcataactactaagcataataaaattaatcaacagtaacaccattattaaaattcattgtagcacccgaaaacaatatattatggtagaaatggggtcttgtggtggtatgcattacttatataacagagccaatatatgccaaagcgaaagcaataatgcaaaacaaaatttatttttgattatgtagaaaataaatgtataatgtcttatataccatataatttcaattggcaataaaaggaggagaaacacgccttaaggtgacgacttttgaaactaaaactgaatagcaaaagttcgatgtttggattttgtttctcggtttcaacactgcaaccttggacaatatatagttgcatgcatgggaaattattctaaagatttcaggagaatttttaaagtttggataatttgtaatgtattaaagtggcactgctattgctgcgaatgtagaaaagtatggcacttaagttgcagacttgtatagcttcaatgttttagaaatctcaaataacttcacacaaataagtcaatacatgaccaaaatatattaaagaagaaagcaatattgtgcaggtatggaaagtggaaactacatagccaccacactacctcagcgactagattaggaaataatttaaatttcaaaattaatgtttgattgttttactgagaggggaataggattagcaagcaattaaagaaacatgaagactaagtggaaggataatggttaatcttggtgatttgagaaaggaacaattgcagctagctatataatatacattaccttgtgtcccatctttggatggctcagttgccacaacagagatgagaagcagtgcgcagaggaagcacaagaagaaaacgggtttgttattcatttttgcaattaggttatataagatgagttgctgtgaagtatatagaccgtgtttctcgacagctatttatagtgatcatgagagaagataaacgaaaggagataaaaaaagaaacgaagtagatgacagtggtcattaaattcgttttcttaaattatggtatttatcttagttagataactggaattgtttggctgattgcgaggataatagggggtcaatgatccttatcaacaccgattgagccattaaagtgttagactgggacaagtgtgtatactgaggtaaccaagtttatcagaagatggcaactggcaagtgaccaagacaatgtgcaaactggttgcatcatatttaattatatacaggaaataacaaggatattatatcatataattaattagctttaaaatattcaacaaaattgctacatataatcattaatcgacatggatatattagtgtttcggttgaatatttcaaaatttaagtcccacattaatagtttcgggatttcttgttgggtttctcggatcctcaaatatcaaattgtagaagcggaataaaatcaaagggggagcgagagagacaatcagaatttattttacgtgagaaaaccttcctcaatgtgagaaaagaaaaactcacaggacctagtccaatatcaaatccactataacaaatatgagttacaatgaatcaaaaacacaccaaaatggtggtacactcaacctctccaacaatggtggtcactcaaatgctcacagtgtttcattctaagttctcaaatatgcaagcacggtggcttgctcaaatatggcactcaagactgtcacttgaggctctcaaatttccgtgtcttttgcctccacccttactcatctatttataggatgaaataagtttataatgggctgggcctaagccatcaaatatatcttatcaaataaaaacaagattatatcttatcaaataaaagcaagattatcaatcaactaaaaacggaaattatccaacaaatctcccccttccgtttttcagtgagatcggggtcttcaacttcaacaacccgaccttctttctcggcttcaatgtgccgaattcatcagtccggctccttcacagcaatcttcaaatttccatgctggtaccgacttggtcatcatatcggaccagttcaaatcggtgtgcactttgccaagtgcgagctgtccaacctccaccacatcccggatccagtgatatctcacatcaatatgtttggtgcaggagtgataggtcgagttcttcgcaagatgaattgtgctctggttgtcacacatcagctcgtacttatcttgttcatggccgagttccatgaggaacttcttcatccacagcatctccttgcttgcctcgggtcacggcaatgtactcggcttcggtcattgaaaagactttaacctatctaaggattcgcccactcatccattctataggcccatttgatgttagcgaccatgacaacctccaacactagattagggaccttcttagcacccgcaacttacatacctactcacatgtaatgtcattcatcaatgcatatcatgttatgatcattcaaatcaatatcatatgtcatcacaaatttattcatcaatctcaacaccataagagattataatattatagattcacaattcatacgttaatcacattcatgaacccacatatagttcaataagcataacaatacattaatttcgacaccttgatttcttgcaagcaactcacagaaactcttgaatgtgaatatgatgatctcaacacaaagtcaactctaataataaaacaacattatctcaaccacatctcatttcatcgtacattcattaagatctcaaataattattttacataaggaaaacaagcattaatcacatccacatccaaattggtcattggactccaaactaatcactagtactcaaaagggtcactagacttaaaatgatcattggactcaaaactgactattggactcaaagtggtgtgatgtaggctaagcacggcaagcgtaccgctttgtcaagtagtaacttggtaagtctgaggtcgatttccttagggaacttgcttgtactgagagttgatatatgtctaagtttaagcgaacacaaatttaatttgaaagttttctactctaattgtggaaatgtaaagtgcaaggtaggtaaagatagttgagcatgggcataataaagagatagaaacacacacttgggggtgcaatgtcggtagatgcggaagatggtgacgtgtgtgagttcaataaaccaaaactaccattgattcaatattaaaggtatttctctattcaacgattaagttcgctcacccttatctactaatgtattctaaccttgattcctcaagcactaaaagcctaaatcacttgatttcactcctgatccctcagcaagctagatctagtaatttgcattaagagtaaagatgattcgtaacctaggctaaacaacatcactccatccctagacatgacatcatttagaagcgtttttcagttctaaggaaacaaccatttctcaatgcattgaagccctataacaaagcatgcatatgggagatcaaatcacacacatgaataagctcagaaaaacacaatgatatgaaaatagcattaaatagatagttaaaattattacatcaagagtatagttgaaaccccaacattggatgggttagcttcccattttcatgagagagcttacaaatatggaattaaagaaggagagtggaaggggaaggaaggaaatggaggaagagagccccaaaatgagtgggatcctcccttctctcgtgccctagctctgcctcagcctccccaagtctccatgagagtggatcagcaaaaagctcctcattttgtgcccgaatttctcttttatagtggcccagaattgcggtgctcgctgagcgggaaaaggtcgcgctgagcgcgccctcccttgttcagctggataagtgaccacgcgctaagcgggcatctgacgcgctggatgagcaactttagacctttaattctcctcttctttccttgcagtgaaatctctacaaaaacacaaccaacccctcatgaatcaactaaacttagcatctgctggacaaaagctcgaagaaagctaattcttatattttatttacaaaaagaagcatcaaaataggaaaagaatagataaatgctaagtgattaatatatggttttacgtatgcttaacaattatcatggtggctggactcaaaatgatcactggactcaaaatagtcattggatgcaaaaatggtcaatggaagcgaaactggtcactggacagaggtatgacagagattttggcagggtcgagggagagtaggtgcaatggttcttgtattgcacaaaggtatggacggagatttttccagcgttaagtgagagagtagtggcgatgagggtttgctcggtgatgtcaagtctatagatcattttaattgtttttcttaattttcgttttatttttggttttattgtcgaatcattgtacctcttgttcttgcaaggggagttcttgtagcaagtgaatacagagatgttggtactcgcccttgaagtgaaagtatttcatggtttgatttggatttaattgtacaatggttggaggacaaagagaaagggacaaacaatgatgttgtgccataaatgaatgatttagtacacaggtggatttgccttttttgttttgttgcatttgggttatttaggtgatgtttaatttgagtgtttaatttttgttttctttttttgaaaataattttcattttcaagatttaaaaaaacatgtatcgagaagaaagtactttaaggtgtcacaacattttcacttctttagaaaaaattggaaatgttaatttgttgttaagttttgagcctatttttaaaaacattttcaaagaaaatgtttttaaaattttaaataaatatattttcacttttatttttttgttttccttgaaaatgaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaacacactcaaactaagagtcactttaaatttagtgtttctatttgggttagtgactgttctatgtaacatatgcttgattagtattcttattagcattttccttcaatttggcatgaataaatgggaaacgtttggggaagggatgttattgtagaaagaaaagaagaataaaacagtagatgtgtagatattgtccaaggaagggaagaagaattaggaggaatgagatcttaattagcaattttttttttattttttttttacaaccggttgatgaatgactgttataagtaaaaatgccatgttcacaggtgaacccctattttgaaacacttcaccatagacaaacccctttatataggctctctactaatcacaaactaaatctctaatagcttgcagcctataaaattaactttcaacatgattgatatatatatatatatacatatatatatatatatatatattaaaaatatatggaaaaggatatttggtgaagataatttcgtgaaatcttgaatgaataaatatatagtagcgtcaatgaatataattttgttgcaaattagatactctacgtaaattgtcaaattttcattcatggatcaacgtaaagtattatatgaaaatggaacaatgaaaccgatcgagtatcatctccaaagctacatttaagttcaacaaagaactagatactagttgtctaactctagactttggttccatgtccaccaacacgtcctttccctttattctatatgccatagccttccttaatactaattcaatatcctccttcgccacctttgtgtcctctatctttgccacctttttctctttttccatgatcatcgtctcctttttcatcacctccaattcctcctcctttatcgccgccaccagcaccatagcctccgccgtcgccaccactagaacctcctccttcactaccaccaccaccaccactgtaacctccgccacctgatccacttccaccacctccacttcctcctccttggctaccaccaccacaacctccaccacttcctccttggctacctccacctccggcactgccccctcctcctttgcttccaccaccttcaccaccaccgccgtaacctccaccacctccagcgctacctcctcctccttcgctaccaccacctccagcactgccccctcctccttcgctaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaccccctcctccttcgctaccaccacctccggcgcttccccctcctccttgacttccaccaccaccataacctccactgtcgcccccttggcttccaccacctcctccagcttcgccacctcctccgcttccaccacctccggcactaccacctcctccttcgctacctccgccaccttcgccacctcctccgcttccaccaccaccataacctccaccactactaccaccacctcctgatccaccttcatcgcctcctccccctttgtcaccacctccctttccctttccttttccctttccttttccacagtgatcggtatcatgatttagctggaatttcctaccactcaaaactgcataaaccgccacatttaagattcacgtaccttgttataaaagaaaacatgagaagagaaaagaaaatacttacggcttccctgcacttcatcgcatccactaaattcttcgtgaattccgtttgttcctgcagtttcatcaacaaaggtaatgattagctataaattaagatttaacttactacatgtcagttttacgtgtgtttcatgaacttaatgttttggaaaatggagtttacttatatcacttttataaacaatctttttgactaaattctttaacaaaatcaaataattgatgaacaaataaagtgcattattatcattaaccttaaacaagttaaggttcatacctttttcctcatctttcgatggctcaccagccaccaccgcagcgatgaggatcaccccatacagaaaacaaagcaaaataaagggcttcaacagattcattttgttagtgaacataacaacacttgagaaggatgaatgcaaagactcaacaagacccatatatatagtgcaagaaaagtattaaagtattgcatgcaacagtgtgaagcgggtcctacttctgaaccatctccttaatactttttggtttcttggcgtattttcaggccttttctctaactttaccttgaaaataagattatccagacgttacattgcacccagattcaaacctaattaaggaaaatggcaaggcacattgaagttcaagtataagatatttattgagatgctctcgatagaatcagttccatgccctattatccgcgcatcaaggttgaaactttcttctttaccattaatgaagataatgaagaacaagcggttcaataggcgtgttcatgttcttgtgacaccttgaatacgcgtgttcatgtaagaagtaagataccatgcccaacctcggcatgtcatctacataagcgttcttactttctttcaatcaaactcattgaagaagaaagagagagaaaactaaaaaggacacagaaaaggagggatcaaagagaagaaggaccatttatgggtatcatgtattcggtgtaactgaatttccatggacggtgcatgaggacaaagtggatgaggctagtaatgttcttaatttcatgaaattgaacacacgttatcaacacgtacgtgtatacgtgttaacaattttttttattacactctgtagattgtttgaaatttgaatgagttaaaatgagcttcactaactactgtatttgaaaaaaaaaaatcatttaacttaatcaatcattttaaatcttgaatacttaaaaaaaattattaacaaaaaattaattctaattttaaaatgaaaccaacttcctctttaatttttaatatcaaatgaaaaatggtttgtatgtattttttttctaaatttattatacttatacttatatttatatttatatatcaacaatttataagtttaattaatagttattttaatatttaattttataatcaatagtaaaaaaatgagtaaatattgaaataaagatatgatggttggatatactaaattgttagagacataagaaactactaaattatctgcatatatacatgaaagaaattggcatttgtaacttcttaaatgtaataattttttcaaatatttgaaattatagttgtaatgttttacgagtaatatttatgttacttaagagattttttaacattttatgctcgtatgttaaaaaacaataaactttttttataaaagaaaaaactttaaaatcattcttacatcgcgaggcacaaataaatttcgaaaaaaattgaaagaaaaataaggaaagtcctctttttaattcatttaaatataattttataaattatattggccttaattaaataataaacaaaatcatacatattttaattttaaaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaacttccattaagaatatgtactggaattatataaaaataatccatttgatttgatatcttgatcataaaaaattatgagtgtattaggaatgatcaagaattatattgtttagagctaaattaatttttaagtcaaatttgaaattaatgtttagagctcaaattttaaaacaaaacaaattaatttttagtgactaaagactcttttacatggcaaaaatatttagtcatcgtatacgtagcgactgatttaaagacctattaggaattgaaactaaatgtttaaaaccaaaataaagttggtcaataaatccgttattgatgacccttaatttattcccttaaagaaaaaaatttagaaaccaatattttgcaccaattaaaataaattgagatcaatttctagttgttaatgaaccataattattttttatttagacattatatttctgtcactaattaaaatgtaattaaagagtgatttttcatttgcaaatgtgccttaaaatttctacacatcactaaccctctaactcactcatgaaaccaacactgtactgctgccactcacattcttcacttatcataaaatcacacttcacacatgttgattttcttccccttcctccgtaacgtacaaaatcatacgcatatgcatacacccatgacagcatgcatagattaattcctcctgcatttattggtttgctactgtgctcctggctcctgcatatatatgcttcctttatctgcacgagtttttgttgttgttcgtttgatgcatgaaagggaaagcgttgctctatttaatcacgaatttaaaagtgttatgtatatggctttagtttagtctattcagtaaaaagggagagaagcgtccacgttaggtttcaataatattgtaaatacagataatttaattaataatgtaaaatattaacaaacaaatccttaaaagaaaatatataaacaaacaatataaaatctttttatccttagccttaattttctgtcaccgtacttttttttcctttctttttctattttctttagaaagtttctaacttaaaattaaaacaatttttaattataaaactcttttttatccgtagccttaattttgtgtcacgttattttttccttttaaaaggcttctaactcatgaatacgttagaaaatgaattcaatgagcaaggcatcataataagaataagcgggtttaatagcaacatgaatatgaaagaagaagaaacactgtgacactatcacataataatcttaattattattgataaaataactctaattcaaatatccggaatagctctttatgccaaacccacgaggtcttggaccatacccaccattgggtccccctccataaccgccacctccgggtccaccaccactagacccacttccataatttccaccccccgatccaccacctccaggcccgcctccataactaccacttacaggtccgccaccacttggaccttcacctcctccaggtccaccactgtagcttccaccaccaggccctgcaccacctgcataaccgccacctccggatccaccaccacctggctccccaccttctaccgatccgccaccactaggccctccacctccactagacccatctccataactgccaccacctggccatccacctcctccagacccacctccataaccacctgcgggtccgccaccaccaggccctgcaccacttccaggatcgcctccataaccaccaactccgggtccaccaccacctggccccccaccttcttctggtccgccaccactaggtcctccaccatcgccaggaccacctccgtaaccaccacttggccctccacctcctccaggcccacctcctccataactaccaccaccaggccctgcaccacctcctggcccgcctccataactgccacctccgggtccaccaccaccaggccctacatcccctccgggtccgccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgcctcctccttgcccacctccgggttcgccaccaattgaccctccacctcctacaggtccaccaccaccaggcccacctccataactgccacctccgggttcgccagaacctggctctccacctcctccaggcccgcctccataaccaccaccactaggtcctccgcctcctcctggcccacctccataacctccacctccgggtccaccaccacttgaccctccaccccctccaggtccaccacttccaggcttgccactactaggtggtccaccacctccaggcccgcctccataactaccacctccgggcccgccactacttgatcctccaccgggccctcccccacctcccgatcctccaccaccaggcttgcccattcctggtataccacctccaggcccagcaccaacagggacaccccatccagggatgatactaccaaaaccaggaatgctccaaccgaagcaatttgacgttgaacagaccctaacaacgtctccatgacttggattttctctatatttcacatcactcacgttgtttttctctttagcaacttcacctacaaatgcatgaacgctgaccaaatgtcataatcacatatttgtcacaaaaataataattacgattaaggaacataaaacaagatttatcgtcaatgtagtccgttacaatgcaatgcataatcgaatttaattgcagtatatgagaattcaaagcaaaatgcaaactcacccgttgtagacattggggaggtctcagcaaggttcctagccgtcacgttagaggatataagagcaaccatggccaagaggcctagaatgagtaaggtttccttagaaaccatttttcagaacttaacaaaacaaacggaatttcaatgaatgtttgctaatgacgtatcgatttgaaaaacagtggggaagtggttctatatataggatgaagggagatagctggagttgagaaggatcccaacttgccaatttagcctaaataataaattcatatttctccaaagaactcaaaattcactcttctgatatcctactcaacgttattcttaattttcggaagtagcatttaatgttttttttattacttaagtagcattgaatgcttgatgaacatgactatgtaatgaaaatgaatacaaatattaaacaagtggttatcctttgtatcttgcattggttataagcatcaaagtcaacagggaaagataacttgcaatttgctataagtgcgtccttcagtttctttgactgagcaagaacaacatttaaaaagaataaatatcaaccaaatttaatttgctcaccccctttttcttaaatgaaatactattaaatcattataaaatttatggtcaagtttctcatatttttaatttcggccaaataaagttacttttaaatttaacaagactttcggaatcaaatataatatagacaatctttcagattaaataatgtatgtctttgaaagaatgtattatgtttttttctttcttaaagaaccacatgtatgtcattattctttattactttaaggaatacacaccaaccataatttcccctcccccccccaaaaaaaattgataaggacaagcatgtaaatttatatacatcacaaaagttcacataaatttaaatttaaaaatatagtgggatatcaattaaaaattaacgtgcatatatgataatacaaaaattaatgaaaaattaaaatagcatttaattttatttattattaatattatgaataaggcagtccaaaattattgattattaatataaactaatattgagctttaaaaaaaactataagctatttggctttggatttttaaaaattatttttaaataatttttttattgattttaaacctttattacttaaagaaatatacaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaatcaaataattgattttttatttataaaaacattagtagtgtattaataatatttttatttgttaatcaatattcttaaaactcgtactcattaatatttggcggatatatttatcttcgactgctactaaatttacctaaaattgacaaaactattctataaagatactaataactccactcttaaaaaataagcgtaaatgatgttatcgtcagcactcaattaaatttcatgtcatgaaattaaaaaaattattaaagatactaatatcaaaaacaaaatatctatcctcttcgaagcccattttttaacattagtatttaagccaatggcccaaacttcaaatcagtcgaagataacaaccttcttgttgaacattccctttgtcatgacgatgtgaaagaagatggggcaatttttttttggaagaagtggaacaatttttttattatcttgatcttcgttcattattatatattttatgatattttttaaatgttattaaaagtttttaataacttttttattaaatgttaaataaaaaaatattactaaaaaaacatatatgtagtaatgattatgagtaactgggacaaggaggctttgccttcctccatgtaaggttctatatatagatttgttaatatgtactcaccactttcagttgcagtgtattaatatacccaaagtttgtgacaaaaaccccaacacatctcttattttattaatttattttaaggttattataataattaaatgttttaattttaaaattaaaaaataaaaccactttctgttcgtctctctccgtcgtttcggaattctgatccatcatattctcaaggaaaatttcagaggcaccatcaaggacctacttgaagaatacgataacacaaaccaagagagacaatggttgacttcaattttgtttatctagaataaggaaatgcaacattgaattgaaaattaaattacaaaggaaatgcgttcatggttattatgggatttgcaatggatggtgaatattgaataatcatcttatcattcttatggagacaatttggaagtgttattcgttaaaggcaaggagtgccatgtgttgttgggtctaattccaatgtaaatcatgaattaaagtagcaattagttttcacaaattcatcctcatgaatatttcatgggctgtttgaatgaccttttgtgataaacgtggcttgtttttgttggtgagatgcattatcatgcagcgaaggcataatggtaagacgcaaatatgggaaacggtgtgagagaaaagtatattggtgagaggcagacgtaacgacacgataagagagaaaagtgggaagaagatttattttcaatttttaaaataaaacattaaattactgtaatggacctaaataaattaagaaaatgaaaataagtggtttattttttgtctaatttttttatatataaaatgctaatacacaccaacttaaaaaatgatgagtgagtattaacaaatttcatatatatatatatatatatatatatcatgatagttattagtcgttaataattttaaattattaatgatattagtttttaataaatgaaagaatcattttaaattaatttgaaaaaaaaataaagaatttaaataatttttaaaaaataaaaatttaaactgaaacataaaattaagataaagaatcaaaagttatatttaaccaaacatataattaaatattataacttttttccaaaagaagtgagaccttggtgggagcagggataacaaaagtatacatactcaattcataacggatagaagatatatacttaaacaagtaactttatatattttaaacgggtatatgtgtacttgttaataaatgagagtataggcaattaagtatcatggtattagcttgcgtgtatccgttatagtaagaataattaaatttagtttctaaattgaagtattttgattagtataattgtatagaataatatttaagtaattttagttttttagcctttaaactatttttttaaataaccagttagaataattaaaagttatggttcaaattttcaattttaaatctttatgatgttgtttaaattttaaaaatgtgtttatttagtacttatttccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttatcacaataagattacttttttttttcctttgtgcaactacctcttataaaatctttgggtttatcttaataattacaaattgtttaaaaaagtgttaataattaaaaatgtaaaattttaaaataatgttagtaaattagcttcaaatattaaatactttgtgttagagaaacttataaaaaaattcaaagaaaataaaaatggatacaaacttaccttatatagagataaagatacaaaaataaaacaaaaaacagaaagaagatataagaaagtaaaaaaagttgaaaggatgaaacttaaataaatttagaataataaagacaaacggaaaatttaagaaagaagaaaagttaacaattatataaaattaaaattctttaacaaaaaggaaagataaaccttttcgattcgttgcacagtaatactttttctttataaaattaaaaattaaaattctttataataaattcgtaactgaccaaaggtcctttgggcaaagtgaaccccagaacaacacccaaagatctttcaatcaaggtcatggattgagttctcactgcagacatcgaacaaatgaaccgacagttattcaatttaaccataagcctgaaagtcacacaaaaatgaaatcgtgtgaattggacatcacttgcgcttcataaactagttgaagtcatcgattattcaaacaaataagatattaataaaacaatttatataaaaaatacatctgattatttcgttagattctttaatgatgtatcaagtcattaaattgctaacttctcttgttataataccagttaatgttgttacttaataaaaaaatattaaaagtggtaaaaaagaaaaaattcaggaactttgacggatcaaaacttagattagagtctaataacatgtttggttcatgtctaacacctaaacatgcataaaagatgtggaaaacataagctattaagagttgcttctagtttgacgtgatagatggatgtacattatctttaatgtgatgctaaaccaaacatcagcataaatgcaaagaaatagtacactcctcccttttttactacaaggatcaatttttgaaaattaataaatctattaaggttttgggtcattcaaaggaacaacaatttcaaaccttgtgtttaagttattgggctttcggcccattaggagtttattaataaaatgaaattattttataccaataataaatatatttttagcaaataattaaattagttaaagttagtggtaaaatgtgtgaaataattatctatatcattattatttttggcaacttaaagtataataagaaaacaaccacaattttacattagaaataaacgtgtaagtggatagaaaatattttgtaaattaatgtctagaaaaagtggttctcttaagtataattttttatagaaataataatagaaaattgtaagtatttaagtatgctctgtagttacaacatagtctctgatctttgacataaaaaagaattattcttaatattatatagtaagaaacttagttaaaaaaattgataatttgcatcacctatagttattttttagaaaagttatactttttaaataatccaagttaagaatttagaaaagaagagatggataaataaattaaattaaattaaatctagaatttatgcataaaagaggttttgtatgcatgttttattaattacgcttataaaaatttctctgtgctctggaatattttgacaatgtttattatcattgtatattttatgatgattgctgtgaatataatttgaggcagaagtgtgatatatatttgtgatcactaagttagtggtcttcaatctttacgagatttttctaatagtatatgatgaataacaagtcataggcatcccgtgttaggactataataagaccatgctgtacgtagtgaagcatgattgcctatgtttgaaaataacagtttggtgcactgcgtgatgaaaaacatggataatcattcaggtttaatttttagcgtaaaggtactgagttttgaactgacagataaaaaaaaaaagcctcagttaatgtcttaatggtacgtgttagcgcccttgagttgggacaaatcacataaatcgacttggtaacggtgacccctctcagcatcacccagattggtgaaatgtacatacttgttgatgggttggaggatctttgctcaagtataatgactacaacatggatgtcagtaacttgtgccgggttatacgagctcccaatggttcctaatggttaagggtaaatcattagagatgagtatgaatccatacgtctagtagaggtttgtggttgagtcatgacaatttaggtcagaccttacttaggctcttgtattgtttgttttatacttgtatgttttaggttttaaaacttattgagaaaataaatgggctcgtgaaacctcattccttgttgcttttcttctgtatgtataaatgtgtatggtacaatgttggatttggctgtggataagaggaggaagaagtcgttattaaggatagtagggacgaaaaggacagaggaagacacttcaagacattcgcagttggtatgtgtaaagatatttgtgattaattgaaacaaattaagaaaaatgtaaacaaccggtgttggctcaaggcgtcacgtacggttaccaagtggattccatatgtttacgcctaaagctaacattcaaatacatgtaaacaagtcgaacaatatgagaactgagggccataatatgatagtttcaatcatcgctacaaataatttatagccacaacatttaaaattaatatgaacatgtttccctttctcttcctccacctcaagaaagcacataaagaaatatatgataaagaaaagataaaatttaactacaaagaaatgacgaagatatgtagtaacagtagaagtaaaactcacgatttagaggacaaactataactttgtgcacatatatcataattttaatcaacattttcttattgggaaataactgcagtgataattaacaaaggttagagaaaagacaggcctccttgctgactatatccatgcctctcataacacgagagcattctacgaaataatctacgaaagcattctaccaataaagatcttccgcaattatggacaaatgtatgtttatgtgaaactcatgaattctaaagatccttttcatgttcttgttatgattgaacatgatattatagattaatgctcacatgtggtatcagagcacggtttaagaatttgtgattttccattactaagttttgttgatgcaacaataaagtatttgaatcttaattttctgcttgttgcgaatattattgatcaaataatattgataaaataatatcacataattgttatttctcacttggtatgtcatatgttccaatggatatcacgataaagtcctgatggtgttttcagttcaacatatatatattaaatgcaaattatttttcctatcactacaagacaaagacacattaatgttagtgatgaaaagtaaacaataatgattgatcactttattgctcccctattcaaaattgtaccaatgcatatttaaaattgtatttgataaagtgtatatgcattgaagtgttgtgatnnnnnnnnnnatattttgttgacactgaaaattaattatgatgttagaatgtgtttgaatgttgttgaaatcttatgattttaacatattttgtattttatgaagtattgcaatcttggaattaaagtatggtgaatttgttagtcaccaaagtgaccaaatttgtatgagtgatttaattccaaattgtatgttcatttcaagtttggaattaagtacggtgaatttgttagtcaccaaagtggccaaattcttgataaattgaatagttccaaacattatgattatgtttcaattaccatgactgtgatgctattaatggtataaaattattgtttatgttgtggtatattgaagttcattattataggacagttaaggatcaacccaaaggatgattacttgttttataataaatgaacatgaacgttgataatgttgatacacttctagttttatttggacgtctaaagatgacaaatatttttagttggggtatgcatcataatcaaattatgtgaaatcttattagcatcattatagttgaatgttgtgtattaatggatccccaaaggtgaacattagtatacatttttatgatgtatgaatatgtgaattatgttcgtatgtgatatgtatgattcaaagcattaagttttcaaattttataccttgcaatacttgttgctacacattcgcttttctcaattattacagttttcaatggacacttctctgaatagaaagagcaaattgaattttaccttggggtaatggatttggatttggctcttagagaagagaaacctagtgctattattgatgcaagcactgagtatgaaagagttcattttaagaactgggaaagatctaataggttaagtctaatgtacatgcgaatgagtattgcaagcaacattaagtcaactcttccacaaactgaaagtgataaagaaatgataaaacttgtggaagagtgctcccaaactgctgacaagtctcttgctgggacactaatgagtacactaaccaccatgaaatttgatggttcacttactatgcatgaacatgttgttgaaatgacaaatattgcagcaaaactgaagtcattgggaatggatgtggatgaaaatttcctggtgcagttcatattgaactcattaccgtctgagtatggtcctttccaaatgaattataataccatgaaagacaaatggaatgtgcatgaattgcacaatatgttagttcaagaggaaaccagaattaagaaccagagaattcattccatcaattatgtcaaacatcaaggagttgaaaagaaagagattccttatgacccaaaccacaaggccaaatgaaaagtttgtccttatgggtaatagagtgaaatttccaatgaaagctgttgggacttaccgtttgatccttgacagtggacatcatttggacttatgtgaaactctttatgtacctagtatatctaggaatttagtttccatttccaaacttgataaaactggataatcttttaaatttggtagtagtagtttcagtttgtacaagcacaatcatttgattggcaatggtactttatgtgatggattatataaattatgtcttgataatctttatgctgaaacgctaatgactttgcatcataatgttggtactaaacataccttaattaatgaatgttccgcttacttgtgacataaacgtttgagacatagttccaaagaaagaattgaaagattggtaaagaatgaaatcctttcggatttaaattttattgatctgaatgtttgtgtgaattgtatcaaaggcaaacaaacaaaacacacaaagaaaggagtcacaagaagtactcagcttcttgaaattatacacactgatgtttgcggatcttttgatgttaactctttcaataaagagaaatattttatcaccttcattgacgattattcacgttatggttatgtttatttgctacatgataaatctcaagctataaatgctttatagatttacattaatgaagttgaaaggcaattagacagaaaggtgaaaattgtcaagtctgataggggtgatgagtattatgaaaggtatgatgaaagtggacaacatccaggcccatttgctaaattcttagaaaagcatggtatttgtgctcaatacacaatgccaggtacaccacaacaaaatggtgtatcagaaaggcgtaatagaaccttgttggacatggttagaagtatgttaagtaattcttctttacccatttcattgtggacttatgctctaaagattgtcgtgtttgtattaaatagggttcctagtaaagcagttccaaagactccttttgaactgtggacaggaaggaaacctagcttaaggcacctgcatgtttggggttgccaagcagaaattagatactacaacccacaagaaaagaaattggatgcaagaacaatcagtggttatgtcattggttatccagaaaagtcaaaagggtatagattttattgtcctaatcataccacaaggattatagaaactagaaatgctaggttcattgaaaatgatgaagtcagtgggagtgaaacaccacgtacagtggcaattcaagaattgagagtacaagttcctttgacttgtagctctagtaaagttgttgttcctcatgttattgaaccaattaataataatgaagaacaacaaatgaatgatcccatcgctcatgatgaaactattgacaatgaacccattgtagaagaaccacaccaaataacattaagaagatctcaaagggaaaggagatctgctatttctaatgattatgtggtatatctacaagagtctgaatttgacttgggtataaaagatgatccagtgacgttttcacaagccgtgaatagtgaagatggtgacaagtggttaaatgccatgaaagatgagttgaaatctatgaaacagaatgaggtttgggaccttattgagttaccagaaggatgtaagagagttggatgtaaatgggtctttaagaccaaacgtgactctcatggtaacttagaacggtacaaggctagactagttgcaaagcgattcagtcagaaagatggcattgactataaagaaacattttcaccagtttcaagaaaggattctctaagaatcattatggcattggtggctcattatgatatagagttacaccagatggatgtgaaaactgcctttctaaatgggaatttagaggaagatgtgtacatggaccattgcaagaacaatctagagtaatcctggtatgaatcattgaaaagctgcaaagaaagttctgagatatttgcaaggcactaaaggtcacatgattacttataggaggtctgtaattgctgcatccactatggaagctgaatttatggcatgctttgaagccatagttcaggctaaatggctgcagaactttatttcagggcttgaattggtcgacagtattgatagacagctgaaaatttattgtgataattccgtagcagtcttcttttctaaaaatgacaagtattcaaaaggtgctaaacatatgaaattgaaatactttgttgttaaagaagaggttcagaaacatatagtgtctatagagcatgttagcactgatcttatgatagctgatcccttgacgaagggattatcgcccaagacatttattggttatgtctgtagtatgggcattatgtcagctaatgaatgttgatcattattgaaattattgactattgacactctgaattcagtgatgtttaagtttctgaaaattatcctgttttcaaatttatgtatacatgcatgtatgaatgattattttgaaaaaaacaggattttgtccctaatgaagacataatagtattattgtgggacattatgatataaacttccattaaagtatcatattaggaagaagagctaatatagtggtacatggaaggaactatgccgatttgatagcatataaccgccatgactcttattggttttatttctgatcatgatttatgatgatgccaatgtatgaaaactttagccctatgaatgcgcattataattgttttcattaaatcatgaaatgaaatttatgacatgagccaagtgggagaatgtaagatttatcattgtggctcatttaaataaatgttatttgatttaatgaataaatgacataaagataattggttacaaagggaagttattaaaggataattgttaataaaataattatcttaaacgtattaaaaagataactgttaagatatgcagttacattaaaagataactgttgataggtgtagttatattaaacgtaatggttcagttttcttataacagagagatttagaaaactaaataccatcattgtctgcccatgagagttgtatccaatccctatcaaagaagatacaagaaagaaatggtcaagactctgagaaagtattctaccattaaaggatcttccccaaagaatctacgaaagcattctaccaataaagatcttccgcaattatggacaaatgtatgtttatgtgaaactcatgaattctaaagatccttttcatgttcttgttatgattgaacatgatattatagattaatgctcacaaagccacctccaccaacaccggggaagccgccaccgccaccagggaagcctccaccaacaccagggaagcctccaccgccaccggggaagcttccaccaacaccagggaagcctccacccccaccggggaagcctccgccaccaccagggaagccaccacgaccagcaccagggaaaccacctccaacacgagggaagccagcagcaccagcaccagggaagccaccacgaccagcaccagggaaaccacctccaacacgagggaagccaccaccaccaccagggaagccaccacgaccagcaccaggtaatccaccaccaacaccaaggttacccctgccaccagcaatggctaactgtaacacctccgaggagatcaaaaggagcatggccagcataggaactattgctatcttcgaacccatctttcactctttcagtagtaaactacaacaaatctactcaaattaatgagatatgtctggtaatgaaggatgagaaaattagtcggaaatatactctatatataggagcgaatgagagagaatttgaacctttctagagttaattaataacctaattgttctcgatctccagctcaatttccttctccaatttcaatggtaaagtgatgtaggttatgaaattgaaggacagtatttattgtgcgtaactacatgcatgcgtgtatgaacttcccatgtaatgcaaaaatgatcagtggacaacttatttgacacttagtgcgagaaagagataaaaaagaagtatgatagttgatataatatgatagaaagatagagatatagaaatagtaagtgtaaacttaaggagttggttgagcatagcataataagatatggcatttgacaagtagaggttttaatcttacttatctccttaggttcatgtaaatgtaagtatctttataaaagttctttgagttcaaacaccatctccttccataaaatttttactatgaaaaaagaaaagaaaattagctagtgttaaaagaagtgtttagagaaatagaatatccacctatcattactcaaaaaagtggagaagcatacacctagtactagtttgctatatatcttaatatttttctgatttaccctaaagtataaaataatttaaaggtcaaagttatacatttttgctgcaaagttagataaagttctttaagactaccaaaaatcaacaaattactaataaatacactaaagaattttttttcccttcctaatttgatgctaacaaatttttaaaaattatatatagattttattaatttaaattttttttacttgtatttgttatattttttctaaccagaattacaattttattttagtaactaacatttaatacaagtcagctgaaacttcattttgaattaaaaaaaaataacacaaaaaatacttaagaaatggcatgtaattaaattttttttcttaattaaacatgcttgtcaaataatacagaaaattgtatgtcaaatatgaaataaaataattaccatcgagtgcctagatgaaatagtgtgtacaaaagaaaaagaaacactaaaatgaattttacccattacaatatattttcttcaaaggttattttttaatattatccattgttcctattgaatggttttatacagtataactacaaaattaatatttaattaaagtggtaacttaaataaagtcttatttacccaatcataaaaaagtcattttacgtatataataacttaaaatagctttttatttatttatcataaatcatggttatgaattatgaatattataggtcaattgtttttttaattaaaattttcaaaatcctcatcaaaattagttactaaacattttattattactttatataaagtcctgtacggagaatacttatgtctggtctttcatccaccacttaattataatgttttagtctcaatggatgtcctaggctcctagctacgctattttgaattaaaaacaaaaaaattaaaaagccaacaacatgactagagttttcctttttgtcgacagaattgtgctgtagcctgtggctaagagctacggcgttcactaaatgaaattacaatgtgggaaatattatcatgtttttcttccattacgtacacaagtattttaaacttaattaaattaaacacatcaatacaataaattgttactaaaaacattgtatattattattaatcaatatcttgttatattaaatatgaatgaattaaagagagacatcttttaaaatatcgaagaggaaatatctttattaattaatatcatatcaaatttcaattttaaaatttaaatttaaattaggaatgattaagactttttctttttgtaataaaatcccgtcatgaaggcagtgcccattgcccactgttgttgactcaggttgctactcctagctagcccccatcgcatgacatcgatattggagggggaatgtaagagttgccacaaaagtttgcccaaaagagatatatattaattggccatggggtttagctatgcatgctataggtttcgtgatcacattccagaaaagcatatttcaacccacaactcgtcaattttgctgcacacaccttgcagggagacctcaatttttgtgccacgaaaaaaaaatatttacctgaatgtcacgcgatccaaaaattttactagactgtcacgcgcgtaattcgctggggaatgtagcgaattatggtaatggacacatggcacaacgtggcgtaattcgctggggagcccagcaaattaggtggccacgtggcaggcaaggggtaattcgctggagggcccagcgaattaggtggccacgtggaaaaaaaacgcaaaacttcaaacggtcataacttttgatagaaatgtccgatggaggcgtacgatatgtcaaaatgttcgaaattcaaagacgaagccctgggtaactcccaaagggaagttggtccaccattttttttccaaaaaatgtctttaagtgcctcaaaattaagatttaagagtcaatcgtccaaaaattcaattatttttctattttttaattatttaattagttaattcattcatactttttacttttttgattacttctcttaatttcgagcgttttgacatatcgtacgctttcatcggatatttttatcaaaagttagactatttaaaggatatatcgtactcttaaatactgattttgaggcacttagaagcattgtttggaaaaaatggtggaccaactcccctttgggaagtttcccagggtttcgtctttgaatttcgaacattttgacatatcgtacgcctccatcggacatttctatcaaaagttatgaccgtttgaagttttgcgttttttttccacgtggtcaactaattcgctgggccctccagcgaattaccccttgcctgccacgtggccacctaattcgctgggctccccagcgaattacaccacgttgtgccacatgtccatcaccataattcgctacgttccccagtgaattacgcgtgtgacagtctggtaaaatttttagatcccgtcacattcatgtaaatattatttttttttttggcacaaaggtcgaggtctcccttgcaggagccatagccggctgccctatatattcaagagcttgcccatccaagaggtaaggcttgattggactttctcaaaaacattgtacttgtcgatatttctagccctatggatgccaagagatcttgcaatcaaggtcctgaattgagggctcgcagactagcagcaagtgaacctagatttattgaaatttaccataaattaattctgccagaagccacacaaaaatgagagagcatgcacgaagaagatcacttgtccttggtccatagaggcctttcagaaaagcataacacataaaaatgataaaataaacaaatgagattgtggggcccacatttggagagagatacccagggccaacttgggtgttgtccggagatgcacccactactaaaagagtccaaatttctttttttaaaaattatatgtttgtgtaatattttttttataatttataattttatttttgtaaatagattgaaattattgttttatctctttgttgttcaaattaacaagtaacatgtgattaaaaagtattatcatattagttgttagttttttttttttaaacgtgctacctttataaattctcattgaatgaattgaatgaatttttttaacttatcatgctattttatgatcaatgtaacaaaaaaatatttttaatgaaattactgtctattttttatatgtaatatatatttattttcaaataattaaatacaaattaaaggactttatttagtgtttgttatggattcttaaaatcttaggatcaacactgaagatagttagcagttttttgggattggttcatgttcaactcatggatagtgagtgttaaacactccacacaacggataaaaagaaaagacgaaagagggttacaatgtcgaaggttcttgaatgggaaaagctctcaagctttgactcattctagaggaggaataacatggaaccccacacatgtacaccccatgtgttaaaatcgacgatggtgtacatgttggaaatgccaaactctataagggtttcctggatgaaatattaatcaattctgttataattttttttaggtcaattttgatccaatcatgtctaggcttagtctgtaaaagacaatatacaaattagacaccattgaatataagtattttctgtctaacatgctacatgcattgaggtagctagtgaccaaccaaactcaaatacaccttatgaaatgtaaggattgaactaaattttgagtatgaattaaatttggaccttttagcctagttccatcatggcttgatgtggccttaacccacaaaaagttggaaaacctctaatctttttttccattctattttgctctcactttagatcatttcatcgcatcgtggtgtaaagagtcttatattcttttagtgaacttttaaaacaaaaacatatgattgataacaagttttaaaatagaaaaaaaaaagcagatttactttttaaaatttgcaaaacttaaaacaaaaatcactccaaacaagacctaaatatttacactttaattaattttagcaatgcactctctcaaaacaatgtttctagctaatacattatcattaactaaaatttgttagaagttacaaaattttgtgagtctcaaacgatttttctaatacattatcaatattatcaatccactaatttagagaacaaaatcatttttatgccataatttgcttttaatttggattgtttttgtgtcatcaaaactgatgatagattccctttcatcaactgtggttgcagtgggtcgggtcccaaacccaagtaagaaaaatgataaataaaggaacggaaaaggaaagattattacctgagaaactttttattttgcttttgtcttttgtttgcaattttgcatggaaaactttgggatcaaaactccaattttcctttgccattcccttgaacttaaaatttagagtttgcaattttaccagtctttaaaattgaaaataaaaaaaaatgtaaaactcaaaacactactagaaaaatgattattagtgagggggatataaatttgtcacaaaattttttatgataaaaatatttaattagagagctttattcatcattaaatctaatttaaattgtttgtgacatattttgtgattaacaatattgagggggatataaattggtcaaaaacctctcgctagatgttttatatttatttatgacggattttgtgacagacaaatttgaaaagaagatatttcataacaaatccctagctaatatttcatatttgttttgtgaggaacatgtttaagagggacacaaatccgtcccaaaattaaataaatttctgtccatctcaaatctatatttttcgtcagaaaggtcatcactgtgagcaagggttttttcacctctaagattcatcactaattttgtttattttctaatagtgatacaaacctaattgaaacgggttttagtttttaaaatttagaacaaacaattatcccaaactcttaccaacaacatattagtctcactccttataatgaagtctacttacaattttataaattttaacgagtttaattaacataagataatatattaggaaaaaatattaaagagtattttagtaactctcctcttattgtaaatagtagaaataatatatccgatcacaaataatgtcattaaatatgataataaatgaatgaatgaataattatttttatcctgagagatttaaactcgtgataatttaatttattaaaataataaaattcttatttaatctttaaatatatataaaaatacaataattatgttttattgttatttcacgtaactattttgtcattaagctagctatagttggattttcttcatattttacatctgtcacgtcattttttctccttagcaacttcagttacaaacacgtgaaacatgaacaagtgataatcatatatatttgccatgaaagacagtaatcatgattaaggaacataacacaagtgttgtcatgagttaaataggttataatgcaaatcaccatttttcagaactgaaaatacaaaccgaatcaagttaataaatgtttgctgatgacagctgatgaaatatagatatgaaaattagtgaggaagtggctgtatatgtaggaggagggagatagctggacttgaagtgaactccaaaacttgccaatttaactttaacaattacaaaataaattcagttttctccaagtgctgaaaattcgttttcctgatatcacactcaacgttcttcttaattttcggaagtagcattcattgattaatttgatgctggtgtcaacgtaattctgtggtcaagtaggtaaattaatctcgaacgagtgcatatatatctactgtttgttgttttggttataactaataaggaccaaagtgaacagataaaggtaacttccgatttgctataaatgcttttttcagtttcttggactgagctatcaagagcatttttgtagcagtaattcattagttgtttaaaattaagcattgttaattaataagtttttatcattaaaacatatgatttgactatattgcttaagtaaattgtttatatatataattattacttaattcattgttatcaattaaaaaaatcattttttaattataaaatttaatatgacacaagttaaacacttattctaataactttaacgttaagagtaaatttttgtaaaatttctaaatatatatattattgtaagattcataaatttaagataaacaattcttttaaatagtcatacattatagatgttcttagaagaatgtttacacataacaaatatcaataatattaatttgctcaccccattttacttaaaaagaaaaattaaatcagaacaaactttatggtcaagttatttatatttttccaccaaaaaataagttgcttaattatatttttaccataaaatttctgaaacaaataatgttatagatattaattgtttcatatatataatgtagtctttgtaagactatgtgttatatatgtatgtgtctgacttcatataatgtagtatttgtattatatttatatattactaaaattatgtgtattaaatatttttaaaattaaacaataataagaaaataattaaataaaatatttatattttgttaattttaatttttatgaatgagttagataataattatatattaatatgaaattttatatatgtaatttatttgaaagaaaagttataaaataatataaaaatgatcaaaattatacgtatataattttatccctcctctctctctcactctctctgtatataaaggttttgcacccacctagtggggtgactgcgatctagggagggtaaccatagccagtgctagctcactgaattttgtatatattaataaaggaacaagcatagatttgctgtagctgcaatcaggttgaagatatggtaattataaaagctgaaacttatctacaaagaaataatgaagagattagtaattaacagcataaagtaagacacgatttaattaggacaaactaaagctttgcacacagtatattatcaccatttttaaatttgctcttgatgataacttgattatgtaggtacatgcgtacgtattattcaacattttgttattgttaaataactctagctagtggtaattattgagaaaggtcaggagaaaacacacccctccttgttgaccataagcatgacaagaaatttactgatgagatatagtaagtacgtagtagaactactctgtcatttgtgattcttatcctctttggcctgggaatccaccaccccttccaccagggaagccgccaccaacaccaccaggaaagccgccaactccaggaggggagccaactccaccaggaaaacctccacgtccgggaggggagccaccacgaccaccaggggagccaacaccaccagggaagcctccgcgattgggaggggagccaccacgaccaccacgggtgccaccaccactagggaaggtaccaacaatgcccgggaagccactaccacctccaccaggtaatccaccacgaccaccaccaccaacaccaacagggaatccacgaccaccaggtaatccaccaccaccacgacgactaggtaatccaccaccaccaccaccaccaagtaatccaccaccaataccaacagggaaaccaccaccaccaggtaatccaccaccagcacgaacagggaatccaccaccaacactagggttaccaccaccaaagttacccgcaccaccaccagcggctaagacctccgaggagatcaaaaggagcatggccaacaggcctagggtaggtactattgctatcttcgaacccatttttcagtactaaactacaacaaattaattaactcaaatgagatatgcttggcagtgaaggatgagaaaattagtggggaagtatactctatatataggaggagaggagagagaagtagaacattgctcttaattggcaccgtagcgtatattaatttagtcttttctagagtttattattaagtaataacctaattgtgctccacctccagctccaatagtctcaatggtaaaatctaggctatgaaattgaaggacagtatttattgtgcctgactacatgcttgtatgtaatgcaaaaagtgatcgctggacaactaatttgaaacttaattagtgagagaaagagataaaagaaataaaatataagtgtatgtaataaaaagatacagagaaagaaaattagtgtgttaaagaattgtttggagagataagaatattcacctatcatttttcgaaaagtggagaagtactagacatgatctagtgctagtttgctatcttaattttttttacaggaatcttaatattttatttatttatcataaagtataaactaatctaaaagtcaaagttagataaagttctttacgactattacatatcaataaattactaataagtatagtaacgaaaaattattattcccatacaagtttttaggttagtaatttaaatgacggactttttaaaatttatatatagattattcggtgattaattttaatttccttgtattttcagtattgtgatttttaattaaaattacaatttcattttggtaacttaaatgaaattttattacaagtcaaatgaaactttatttttgactaaaaccaaatcacaaaaatacttaagaaatagcatgtaattaagttttgtcttaaataaaattatatgtcaaataacacataacaattgcatatgtcaaatacgaaaactgattaccaccgagtgcctagatgaaatggtgtggacaaaagaaaaaaaaaactaaaatcaattttacacgttacaatatattttcttcaaagtgtttttttaacattctccattgtgattcctattgaaagtttttatacagtataacttcaaaactagtaatgtttatcaaaataataagtaaactttaaaattaaaatttagagttgtacctttaattaataaagttgtatttacgtgatcttaagaaaaaaaaggttgtatcttttttggtacaatttttttagttttatttacgtgtataacttttacttactttttaacataaaatcatggtgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatcatggttatgatatatatatgaatatgatattatatataggtaagttagtttttgaattaaaattttcacaatcctcgtcaagattagttagtaagcattttattattattttatattaagtccagtacggagaatacttatgtctgatctttcatccaccactcaattaatttttttatttttagtctcaatggaagtcctggctacgccattttgaattaaaaaaaaaaaacaataaaagttaagaacacaagttttccttctagtagacagaattgtgctgtggctatgagctgcgccgttttccaaggtgctaacgtcaaatgaaattgcaatatgtgggaaatactatcacgtttttcttccattacgtacacagttttttaaatttaaataaaacatgtcaggaaataaattaataaaacattttatatttttgttattaataatgaataatttgttagagttattatgtggcaccccgataaagagaaacatcttctaaaatcgaagaggaaaatctttattaattaatatgatatattaaatttaattaggaatgatcaagacttttcttttttgtaagaattcaaaatgaaaagaggaactacaacgtgacaacaggaggcatatccctccccaaagtctctaaaatcgtttcatggcggtgcccaccatcgacattggagaatgcaagagttgccacaaaaatcatagccctaaaaccaggaatgtatgctttagctataggtttcgtggtcacattccaggcaactatattttagcatctgatatccccgtttttgaccaaattatagccatgcacaactcgtcaattttgttgcatgcacacaccttgcggcagccagaattgcatagggtataatggaatggaggaaatgactgatttagtgagccataggctgcctgctctagtcaagagattgcccttccaaaaggtaaggtaggattggactttctcaataacattcttaaagtctgcctagcttattggtcaccggccccatttgttaacaaattattatggtattacgtactcctttagtcgaactagatggtcctgtatgggaataaggaccaaaagggtcttgaggaggctcgaatttaaaaaattgtcagtgaatgctttgcgtactagatgccaattaaggtcaattgccaaaaatgagtaagtgtatggcttgtaaaagaaagactgaaaaccatcccggttaagagccttaaaggactttatttacatggttgcactcttaacctcctcttttgtgaccgaggccagtagtgcctcttgcgcttcttgctcagttaagaaatattaccaacatgcaacaggggccaagaatgttattagaaaaaagagatatgaagtgcctaatggctttctattataaaacatcaaaatttgtatgtaaggaacctttctttagaaagagatcaaagatcttatattccgcattcaacgagagattgtttgggcattaaaaaaaatccagtggtctttatgaggtaaacctgtgtgctacaacacaaaaggtctaaaagataatagtagttacgtctatttgaatataagtttttttataaatacttctaacagaagaaaataaaataaaaaaaataaaatgaacttctccataagttaaaataatttttcattaattaatttatagatgtcatctcatcttttaaaaaagttatattgataaatttctaaaaattaactaatgaacaacttatttcatctttttttttttagaaatacttctaaaaaacttactcaaacatgtcatcggtcatattaaaaaaaatcagaagcttgttgtgggggagaatttacctcctcgcacttccgataaggttttgtaatttcattaaagttcaaaaccataacctcgggcgcctaataaaggcttcgacgaatattagtgagatggtcccattgagttaagctacttgtagataaaaggaggcaaacaccgtgtagcacacccaagtcaatgtacctttaattgttgacctgaaagtagatggcctgaaaagaaatactcacttcttttgtagtaaaggtttttcttttgtccaaatgcaaaacacccaaatgccaccagcattgccctgggcttcaaccagatgacaaacattaatgtcttaaaaaaaattctagaatgactaagctaatgaaaatgagcaatggattaccatataatgatgaatataggatggttatacctatgactcaactcatgaacctccgaaaaccgttttggttgaatttattatttttcttttatttcctcatttttttacttttttttttaattctttaatgagcttagtcatcattttgaactccaaattgaatttggactttttggcttcatgtgttatagtctatgacttgtgttgatactttgaccaacctaatttaaacacacctagtgaaaactaaggcttaactttagattatgagcatgaactaaatttaggtgtttttagtccgatccaatcacttaattcgatatgggcttatcccataaaaggctatacaaatgagacactatgaagcctaaattgaatgtgagtttttttgcctaacctgttatagcttgctacatgcattgttgtagtgaccaacctagcccaaatgcgccttattaaaaataaggtttgaactttaaattttgagcataaattcaatttggtcattttagcccaattccatcatagtttgatataatcttaacccacaaaagttagtaaaagccttttatttttaaaaggaaaagttggtgaaaatcttaaatcttttctattccgttctattttgcacttactccatatgatctagtcacattttcatataattaaaagtctcacattcttttagtaaactttcaaaagaaaaatatagactgataacaagttttaaaaattgaacacaagaaaatttaaatcaaaactaaaaactaaaaagtagtcttagatttttaaaagttttgaaacttaaaaccaaaaatcactacaaacaaggcccaaacttttgatttatatagtatttttatgctttttattctaagagaaatgtcaacaatacaatgtcttagcaaaattttcctaatacatacgttatatcaatgactaaaaattataaataaaaaaaattagtttcatttcttgtttttttttttattatatcacaatgagtattcattagctttgttttgcttatgaccatctacattcgagaatatgtctgatcatcattagtaaatttttttttttaaaattaatcatatttttttcatttataatacttggattcaaaatcttgttcaagggatctaaattcaacttactgagaccaatgacatattagtaagcttgctctttatttaattaggtcaacttaattttataatttttaactattaaaaatgaatatattagagtgttttagtagctagctctcctattattataaatagtaggaatagaataacactgaagacaaatgtcattgaatacgacaataaatgaattcaacaagccagcaggcattaatataatatgggtttaattgcaacattgaagcccaagtaaagaaactttattatttagcactactacaaaagcatcattttacgacgccaaatcaaagtcggttatcacaaaatcgtcgtcgtaagtggagcggtggcatttttgtaaatagtttgccatgtacaaagtcagttgtcaaataaccatttttgaaagctcaatacaacacgttttttgaaataaccgtcgtggtttatcagtgctaatttgtgttttcaaaataacaacgatgggtatggtataaaaccgtctttgttttataagcccaaaactcaaaacgacgccggtccacttgaagctaatttcatttggctgtgtgtgtgagcttagttgcccaaatttcgggaagccctaactaagcaagccctacctataggtaaaacgatcaccgaaggtggaaacatttccactactttttattcagaaaagtatcatacaatcacataattaacataattattgttgataaaaccacactaactatggccttcgggatgactcttaacgccaagcccaccaggcattccaccatatccaccacctccaggcccgcctccataaccaccacctccgggccctccatcataaccaccaccagacccaccaccaggcaaaccgtttccaggcccgccactataacccccaccaggcaaacccattccaggaataccaccgccgtaaacgcctcctccgggtcctccactgtacccaccaccaggcaaacccattccaggtataccaccaccgtaaccgcctcctccgggcccgccaccataaccaccaccaccaccaccaggaataccccatccagggaagagacgccccaaaccaggaatactccaactcaagcaatttggtgttgaacagaccccaacaacacttccataacttggattttctccatatttctcatctctcacgtcatttttcttcttatcaacttcagctacaaacacatgaaacatgaacaaatgtcataatcctatatgtttgccatgaaaacagtacgtaattatgattgaggaacataaaacaagttgtatcataagttacaatgcaatacatcattaattgaatttcaagtttgtgagaattgtaagcaaaatgcaaactcacccgttgtagacattgaggaagtctcagcaaggttcctagctgtcacgttagaggatatcagagcaaccatggccaagaggcctaggacgagtaacgtttcctttgaaaccatttttcagaactgatgaacaaaagaaaccaaatcaaataaatgtttgctgatgaaatatcgacatgaaaattagtgaggaagtggctgtatatgtaggagggagatagctggagctggacgtgaagtggactccaacttgccaatttagcctaaatataaattcagtcttctcccagtcctgaaaattcgcatttctgatatcacactcaacgttcttcttaattttcggaagtagcattcattatttgatgcatgtatcgatcaacgtaattctatgtagctaaattaggttttaatgtcaaacgagtgcatatctactgcatctttttataatttataagcactgatgcatagcgcgtcacgacatttttgtcaaattccatcgattaggggattaaaaagggtatcttattttgtattgtaattctaggaatatttgtaactttattttagaaattttttatattttgttttttaatttttttttacgtatttgttcatatatcttttacactcactctcacacacacacatagtttttctgagatatggaatgaatttctgttgtatgcatagcatttctagtgggaaacctaggatatttttttaattatgatgatgatatatgggatttgatttcgtgtggttgctctcacctcaagacaagcattggcttttgactgtttctgagggatgttatgtatatactttttattgttgtgcatgtctgattatcaagttcccaagaaacacattaatttctcattcagactgggtgatattttttaattaatttatgtatgtaaattaattgccagtaatgatctttatttgtgccattgaaaagatcaagtgggtttaatatgaagattctttctgttgaataaacttaaaatattagttttaatgggtttaatttaataattttattttagaaaaataaaatgtcatgagtcaatgatgattgtagtttatggttatgaatgactataataaattttgattgtggattatgattattaatagaatttaagtcttttaaattcttgaaaaacatattatagcctataaatagatcattatattgtttgacaaatagagagaagaaaaagaaaaagaaattgaacaaaacttttctataagttgttttctccacaaactctcacaacataatttttttctattttaaagttaaaattgtcagcaagtgcattttttccatcaaaatggacgtgttctgatgatccagaaaggtaacaagagtgatcaattctcttaattctcataggcatttttggtctcctatgttatcattagcttcttttttccccctcccttttgagctgcaaatacacagttgaaattattaagctttcccgagtgaataagaatgtatttcataattaaacagttagtatggatagaaagtcatccttgatgttcaagagggtatctttctgaaccttagatacatctagctaacatgtacatatgatttttctttcataatagagttgcagtatataaatgtatgacttgctttattttggattcaactaaaagtgctatggacaagcattgtatacatggggtatcttgcactgatatttagactttggaaggaaggtttgttatttaaatatgattcttctggtgatgtttttgtgatatgaaatatttacctatttcaatttattgtagtgtagagcactctaggtaacacatccttccctatctaggatgtggttggcagaagagaaagaaaatatagtaagtggtagaagggtttgaaaaaatgcactaccataccatgcatcatgtcaagatacattgtcaattttcaccctcttccctcaacttagctcatgtttacttgcacaaggcacgtgattaatttatcaatctaacaaggctgtcccacataatcatttactcaaactttataaacctatgttagcatctttggaactattggatttatgcggaagcgatttaagaacctagtatattggtatgtttatcgaatcatcattgtttcataaacacacatggaatattacttctcggaatactaatctttgatgatctctcacgccttagaattcttgcgtcactgattgatctccttgtagtctgttgatgacagaccttccagactatctctcaagggggaaagggatagtgtgtgtgcactttctcactatcaagagatgaccttgcctcagcctctgtaactgtcatctttttctagagagggttaagtgtagtatatatatgagtttctaaaaaatttaacccttaggtgttaacggactctacgtttttttggactctttttacacactaggtcctattgaactttagtgaaagagcaaaaacccaacatgtaaccaatatattagtgcattattttttatttataaaattctctatgctgccagatcttcttgtttagctgcgcaagagctgatagcagagcaacttgagaaattgctacctccttgtagtttaggtttgaattgtttgattgcttcacttgaaatatttaatataatgaattgcaacattaggaagaattagaaaattgtaatttcttcttcagggtattccattcatttcaatagaaaattctgcaagtaaaattgcattttctacattattggcgtcttaaccttcaactgtaggatgatttgatattgggaaaatctcccctttcttttgttctatatatatatatatattaatctaacaagattttatcagtactataggactttcaaatggaattttaaattttaaaagtagatatgtgaaatgtttcaaactaaaagtaaaagttgaaactgaaagtacgattagatgtgcagtttacttagttttaaccataccattttgcccgttttaagctgattagttaaagcataagatgttcaatgtttgtttttgtttattatagaacataagatgtttactgtttattcatttccatattctcaattcgaaatatattaatataatatatgtgcaatctacctagtctccttaatgaaaaaaatatttatcaccttatttgacttataataataataataaaaggtgagtcagttggcatgtgaaaattcaaaggagtatgtaaacctttgcacatatttagtgtaacgccatggattatttatcaaagttcaatttgagaacttatataaaaaaggcaccaattttttttttatatatatgattgtatgagtatttatattaattgttaatagaagtgtcttaaaaaaatttgaagcttttaatgtgtattttaatattacaggagggaaataaagagaaaaatatatcatatttttttattataaaaaatgtcattctacaccggttatgtaataaacgatgtagaaaatgactacaacatcggttataggaaaaatcgatatggaaaaataaatttcttgtaagtgttatacaacatcggtttgaaaaaattgatgtagaagatgtcatttctacatcggtttttttagaattaatgttgttttgaaccttacaacgttgattttttaaaatcgttgtttcatttttgcatattttatatattttttttgtttatttcttatcatacgatattgattttcttaaaaattgatgttgtgtagtgtatgctaacatcgattttttcaaaatcgatgttaatattgatacttttaaccaatgttatcaaatccggtttggaccgggaccctatggcctaaccaggccggttctactttcagaccgattacgcaattgaactggttaatcccggctgagttggttacctaatctcggttagaccgattcgatcgaccaaattttttaaaaaaaattgatttttttaattaggattttggagtatagatgaactctttttattcaaataatgttagttatatacttatatataatagatacatatataattttgaatttttaatatatagcaagtcaaactggatcaattattggtccaccgattggaccattgacccactacctcgatcgaatcaatatcagcggaccggatttcacaactatgattttaatgccagtgttttcaacattgattaaaaaccgatgttaaaagtctattttataataatgcaacacttatttatttttatcaattcatcaacaatttttttttatcatatcatatcacctatcatatttatattttttctcttatttcactctctctagtgtcaaataacttttgggtatcaaaaaataattttcattttagtcgttgtaaaatgtgtttgatttatttttttacttaaaacgttttagataacactttaaataataataaacattatctaaaaatgctttaaagatggaaaaacaaaataaatatattttaaaatgacaaacaatttttttataggaacaaaaatgaaagttaatactaaattaatgaaaaagatatttaaacctcctaatattatatccaatgccattatcaccacgtctagagaagccaccactcctagggcgttcacgaatgcgttcacttaggtctgggcagcaatgtgagcaatgtccccaggctgtgtcctccccaccacagccacaacgaaaattccctatttctctattagggaaagggaaacccgcatgactaccaatgacaggccaacaaccaacaaaaatggcatcgatcacccgcttcattagtctctttgacaacctcacctgaaaacacattaactctaaacacgtaaatcatttacgatagaaagaaaaatgataaataatataaggagatagaaaaagatagaattaaagtgaacgtaaaagtttaagtataaaaaggttgaatgataaattgataattaattggaaataacatacaaaatgctggaaggagatggggagtcctttatgatccaccgaattggaccaacaacccattgtattgtaaacaacctttaaattaaagttctagtaacttcttaaggacgtgcttggtgggtgcatgctatgacaatgcaacctttcttcagagggtttgcttactgagggggctgtgaagatccaaaaaagctagctttgcggtggcagaggaatctcaacgtgcagaggtgaaaggcttgtgtactttgttattgcaggatattgcaactccttcgtggtggctgatggatatggtagaaatcatatatatggtgtatttttgtgcagctatatatgtatttgattggtgggggagggggatattctgttgtgtagatcaatgggtaattattcatcatttaattgcacctttgcttctaaatgattgtttaacggattgctggtgggtttttgttcatcatttgtacttcttatgggtacatctagtacccttctttattgcaatatataattgttttgctgataaaaataataattaatagggtatagtatattttgtgtgaaatgacaaaataataattaatatataattcttatgggtacatctagtacatctagtcatttctttcttttttgaggttttctttacaatttgcccccaataatgtgaaatgacaggcaggaaatggttgtaaagagcatttttacaatatatatcttaatgtgtgttcctttcgtgtagtaaaataaaaagaaaattacagtaacaacgtctcatggaatttgcactagttacatatccatcccctctcttactattatctccattttaacaataattggttttctccgtctgcttcatcgtgatcattaacatacatacttcatcttttagcatgatcatgcatatcttattagtaagcatattacttacatattcaagagtatcaatcacattcacattttcggtacttaatgacgttgacagattgacatcgaattattaatatacagcaagaatataggttgcatttttatttatctcaaacatttagcaacagtctggaagggtattttttttgggacaagataaaagtatattgatatgtggagtagtcccggacggatcgatccagagatacatcaaagggagaaagctgattttttttttacacagttatttaaatattaagtttgtgataaataattatttaataataaatttcacaaaagttttactattaattgtatttgtaaaattagaaataagatctataatgagtaaaaaaattatcaaatcaataactttttttttttaaactaagaaagtgttgagggagaaaggaccctgcctgctccccttctatccgtcccggcccctaacccaattacataaggtactgcatgttttattatatataataataatagaagcaaaagtcacgattttaaaacaaaatatttgcactgaagattatttcaatttgctcttaaacttgtcacacaggcacagtgacgtacgtattattctacatcatttctacttgagaaaagacaagcctctttgcatccatgcctctcacaacaagagattttattcatgaaataagcacccatgccatgtatggcggttaccattcatgctggcagcaacttaagcaacctcccaaagacgacggaaaacaacagcctctcatgcaataccctcctcttccatatgtagggggtttgccaccaccccattgcccataatcataaccaccaacatcaactaatttgccatgacccacttcatttttctcttgaacaacctcgcctactgcaaacacattaattaaatattaacacatgcatgaaccatttactatatatagaaaaattaattttgcacacccattaattgggtgtatatatatgatttgtgagggacgagaggaagagaaagaaagcaccaccaccaactaatttggcatcagtcacttcatttgtctcttgaacagcttcacctgctggaaacacatcaacccttaacacgtgaaccatttactatagaaaaatgaaatttgcacacccattatatatattaggtgtataattaagatgggtttaaatactcttgttattagccttttttttctttattgctgaaaaaaaaatccaaaatgctctttataaaacctttatttttggtccattttgtttattattaattgcttaggtcctgtaatattttctttattttgaattagtccttataaaaaatataatacagactgaaattaaagcaaattattcagatattacaacgacaaaataatatttaagggtaaaaagtgcaaggataaaaagtatacaaacggggggaaatatttaagtcaaaaaaatttataaaatggttacaacaaaattattttagaaaaatagtattttaaaaaaaatagctagtgtttttaaagcctttattaatattctattatttgaaatgagaaccatataagttaaaatgatatataacattataattaacttgccctcttttaaattcctggctgccacttctgaggagatcaaaaggagcatagctaacaggcctaggatcagtatagccatctttgaacccatttttcagtactaaataaattacaacagatcgagtttgtttagtaacgaaagatgagaaaaattgtgggaatgtatactctatatataggagttggaggaaggagaagtaggcaaacctctctcttaacatattaattcagaattttcaaaagtttctaactgatttattattatgtaagagtaccaaaaggtgttaaaataattgtaaccgaccattctatgatatccatattttatcagaaaataatcttattctaatattaattcaccaatcaccttaatgtcattgctgttagaatattacttaagcaagcatgaaacaaagcttgtacgtcagtgttgtaataataaaatctgagaatcacaatagctaataaatattttccaggcaacatgataataactagtattgatgatattattaaaataatagttgtaataactaataataatattatatacctttaatataaaaaatgcgaaagataggaattttcaattccgaaggattacccttcagtttgagcaaaaggaaattatataacaacaaactaagaaaagaatcttaaaagttaagttatatctttctatatacttaatatatatatatatatatatatatattaattttttatatcatcaaatggctaacaaccattcgacattcataaacgctgcctataaaatctgaagttattttaataaatcatgacgcactaaatcagtatattaaaccattacttttttctgatttgtcgggtgttcttttaaaaaattcagtgttaaattgtgcttagtttaattgaaggttattcgtaaaagaaatatatattttatgctactttttgaaggtcattattaaaatgtttaaaattttgaattgaattgtttagattaattatgcatagttttagttttaacttttttacacattttaattttattagaatgaagactttaattttttttaaaaaaatcctccactgcctcaccctcaagtcgacatctccatcggtgatttctacaaatgtaacattgctgctgcttcaatttgtttaatgatattggcaccttaatttgcggttggtctttgtattagacgtgattctgggagttttgttttggctaaaccggtgttgcaccaaggctcacccccagcacatgaagcagggtacatgagtcagtttgagttgagttttgttaaatttgtgatacaatttaattaaatttgaatgggtttaggttattttttcaagaagaaaaaaaaaatcaactcatttataagtagtttgggttgagttggatcaatgagtcaaaatatttaaatttatcaactatttttaaaatctaatattttttataagttaaattttttattatatgaaataccaaatcattatttataattgttacatataattaaatagtgggaaaaaatgagagaaagaatcacattattaccaccatcatcatataggctagcatattatattaaacatgattaaaaaatttaaatataataaacaagaaacacacccaccaagccaaaacaatcccaaaaattaaaattattacaatatagtttgataatttcaatattctcaattaactaaaacttcaactaaatttaaaatagtttgaaataaattaaaaggtagaataaatattctataactaattttgctgtaaagatttgaaccacaaaatttgaaatataatagtaattaattttataaatttaaaaaatatattatatattataaatagaaataaataataataatttaaatacaaattaatagttcaatgagttggatcaacgtacttgttcaaatattaaaatttatgattcaatccaaaacttaacgagttcaaatgatttgagtcagatttaatccaaaaaaaaaaaaatcaatgtaaattatttagattaatttaaattaattcagattcacaaattatccatattgttgaacatcctgcatgaagcagaagccattgaacggttggaagttgctataattggctcaaagatcttaatttggacaaagttactttcgagctagacaacaagtagtggatgatttgaagtcatgtcatttccgttaacagaatttgcagctatttaaaaaattgtaaaaatattgtcatatttgcaaaatcatgtcattgatttaagataaatcaatcatgttgttcatctttcactatagcatcaaaatcttttgctagcctctgttctccatttgattccaaattgtattgagattcttattataaatgaaatgatataagttacttttgataaaatttgattttggttgctgtctttttaaattgatgaatatagtcatccaactttgaaaaaaatacatgaatttagtatttcctccaatttgttgtgataaaaaatcatcactaaatattaaatttaaacatgtagaggaactaaatttacaactttttttaaaaaaaaatagatgattaaattcatcaaattttaagtataaagaccaaaattaaatcaaatttaagcgaaagtatagaaatttaaaatatattttttgcatataatcgtaacagtgactgaacacctaattttgtgtgagtaataaacaccaaaaataaaaaataaaagtaaagaaaaaaaaagattagtttactccaaaagtataaaagttattcctcatctttattatttattttttaaaatctaataattctataatgaataactaatcttaatcataccacacaacttttggtaagaagtttaggactttttcctttagcatcgtttgattttgctagaaggcctcgccctcaccaacaggtcatctcacaccagaaactggagtttccctcttacccaatattccctctaatcaatggtgacattaaatgaaatagattgaaaactagttttagaatatatcacaaaattcatttctttagttttagaatatattattatttaaataaatttaaaacttatttgtaaagaaaatagtatttttaaagtttaaaaaaatggtgtatttgtaaaaaccaaagtataaatataattaataatcgcgcacattcataattttccaggtagagattatatggtttgggcaatatattgttatttaattacacaatctaattttactatttttttttttcagaaatatcatatttctggagaaacctttccaacatttgttagaatttgaacacattcaaaatacttttaggaagtgttaaatgtttaacatttttcggaaattgctttctcgagaccattttttaaaaaagaatagaaagaaacaaaggcaccaccaaaggggtaaactttgcagttttgggatagtccgtgacagtgttgcagtgaatttgaatgcttgtcatcattgtgattggagtatcatgcattaatgggattcatgtttctacgatctcttttagaatttcataattttttttttagctaggatttattctaaagaaatcaaggaagtgagtgtatcaacctatagcaaacgtagagcatcttaaaaggcaattagtgtccttttttttattattctaaaaattggtttctgaaaaatattctctagaatgtattaaatttttaaaactttcaaaaactactttcgaaatgtgaacattttaacaattccaaaaagtagtttagaaaaaagatatttttcaatataatatatatatatatatataatattaataaaattagagtgtaaataacatttttttttctttcttcgttgttttcggccttgatgctggcaaattcatagctttggcctatattaagccattgtccagctatagattttttttcttctttcattcatttgttcagccttgatgaggtgatgtgctgatattggcttttttttttctttttcgtttttctaagaaaaaggttttattatagtatactgaaacattttttttcatagcttttaaaattgaatcaaatcgatgagtttgacggcaaccagcttgttaaccaatacaaaaaaataagactatttcaaaattagttagggcccatcaagaatcggtcaatccagtcaagaaccggccaatagtaaactcatattttattttaaatgggattatccactttcgtctatatatagtagtactctctaaatccgtatactaataataatataatatctataatacaatatctattattataaatttatatagtaatgttgcaatgctaattgaaaaataacattgtaatattatttacagttaataaaaaatatttaaataatatatcaataatatttttgttactatttacatgaaaagaatgttttattataactattttattattgtctacacaaaattaaactgcttttatcttgatattttatttataactaatctagtaatgtatgaaatatcttataaaaagtattttatatgaaaatgagaggatttaatttagatggtataattatacataaaaaaataaaatttaatatgatgtagaaactaaaaaaagtcatatagttttttaaaaaacttacataatttcttaagattaaatcttaatagttcatgtttaattataaagtctaaatttaatcctcttattttgtatttctcacatataatatattctctctatatactaacgtgaatttatgaaaaagatctaggtcagtttgatctcccactcaccagaaaatggaagaaacatgggactgaatccaacctcaccttcttgcttaggttccgccaacaaagtttccacctcacaatttactggtccactatgtgaacaatttggggccaacattatctgccatatgttccaagttccaactccctttctcgcacgaaatttccctaaaccggcctctcaaatcctatacccacctcaagccctatagcaccaaattaattaattctcttctccttacaatcctaaaatctccctcaaaaacaataatagagagaatgaaggtaattttgtctttcacatatcacattcagcatcacttaatattgatgcatataagagttgtttgtgtaattgtcacagatgcaggaattatatcgatcatcagtttttttccgatccacaaagtcttttttttttttgtctgcaaataaagagtgtatttctatttgtatatgtcaaaagtcaggtacaagtagttacctaattgacccgactacaaaacgggaatgtaaaagatagaagtatatcctcaccaaaggttaatatctattaatgctaaaaaatgcaacataaataaagattagcagccatcagtgttatccctcaacataaacaaaatcctgcaaagcttttatatagcttttaccaccgaaagatatcttcccaccctgcacttgaaaccaaaagagattgaaaaaattgaaccctatatcagctacaatatggctttatcaacattaaatgactgagaatgactcaagcacccgaatgacccaataaacgaataagccaaatacataaatgctgctgccaaatttcttcataaggtccaatcttcaaaatcagcacgtgatagaaccataaagatagttattccagcaaaagacatgtaaaccacttggtggaatcagtttgatccaaaaatccaagcagcagggctagatttccattgactgaatgtatagtcgaaccccccattaaagagaatatcatgaattacattatcgatattatttatgtgaaaccaaagaacacatattgtagcacaccaaatatatatatttctaaatgttgtttgtgattgctgttaggagttgttgcttccttcaatgcttggtataagacttaagttcggtgaaagtttcaaggtgttgaaactttcacttggaatttgtgtttaatgtttcaacaccttttgagttgtttaatgtttttctataattgatgatctagaacttttcctcttctcttagatgatcttctctcctctcctatataaagatagtttgtgtgagagttgtgaagaaaaaggaagagagaaaatttgacaacacctctagagagaaatttgaaggtaaaacttttttatgaaagtttgagtgaatatataccatcattgtaggtgagatttaagtgtaacatcatttgttggtgaagtttgatattttgtacccattattttcatagtgaaagtttgattttgaattaatgttatgagtttttcctttttcgcattgaggaagatttttccacattaaaagattgtttgtgttctctatctctctcctttgtgcatttttattttcactttcatatttaatttttgaggaactacgttccaacaattgcataaccgaaaagcaattagggagtgttgaaggaatttattttaataaataataatggatattcagtttttgtattagagattaaaatcaatttgataattttgtaatattaaataattgatattaatttaccccgtgtctcatgataacaaatttgttacttaacaaccacacttttaagtacgaaaagacttttacaacatgtttagaatgagtcatacgtttgacgggctaggatatttatggaccacacacgattagtctaagtgaataattcatttcaaatgaaaattttacatgtcaattacattataatttgttaattaattgacccttcatgtgtacgagaaattttttagttttataatagtacatatctcatcatagttaatattttagtttagtaacttaatttcttattttatttaaattaatttttaaataaaaaaattatacaagcaatatgtcgtcattaatgtagtaaaggatctattatcatgggaggactaacatgaaaatttaatgtattttttgtttggaagacaatctcgtttcgagttagataggtcattaatgtagtagaaggtctattaccatgggaggactaatgtgaaaatttaatgtattttttgtatatacagcgtatttttcatgaaaaacaatctcgttttgaattagacagcaccattatgaacaattaaatttttctctaaatatttaacatatacacaattgcacatcaaagacttaaacttcatacttttaattaatttggaataatcccaaatcaatttatccacacgctacaagtcaaaagtcaaaaagatcgatatctcattactgaaattttattttaaggattcatattttccaacaaatactctttcatatacatatatttgaaggtcaaatctgtgattgtacatttgaaggttatttggtcaatcatacaacatcatattgattgttgattacatatccttttggatcgagcttatatgacacgttagacatttaaaacttttgctttagtaagagttggctgattcatgctagagaaggtagctactcatcagaaatatgaatatatatggtcgagatacattatcccacatctgccactacaactaaaaaacacttctctcttcttgttcaatgaagaggatagcagtgtaagggtgaaagtatcagggtttcatagtctgaaagcttttttttcttttttatcataattaataattgtattgttggaaaagaatatatacatagtaaccatgatacgtacgtgaggggaggaacttagtatagttacatacaactacactacttggtcaattcgtgttattcggtacttctgatatttgtttataatataatttttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaagaaaataatataagcatgttaaaatgtttttgagcattttgttttaaaagcaggaaatcaaaaccatttgttttttaaaaaaatgtatggcaaaaaaacggtactcaaacaagttttttttttaaaataaaaattattttataaaacacatcaaaaattaaactgctcatatatcttggtgattagttttttcttagcatcgtcgagctatttatacagactaaaggataggattgaattttatgtgtagctgttacataagctggttttctgccactaatcacatatatacgggttttgggctcccactgtgctcacgtatatataatttatactaactttgctgattaaaaaaaagcttgggcttgctttctgaataaaaagatatgtttgtaaggattatctataatgataagataatgataattttagagaaggataaagacataaagttaacaataaagaggatatgatataaatgatgatgatatataataacagtacaagtaaaactcacgatttatgacaaactatttgtacactagatattcccgtttgctcttaaacatataacacaagcgcaacgaggtaattcatcatcacgattttcacttgtcaaatatctatccctcatgcctctcacaacatgagatttattcgtgaaatatattattataagtatgtagaactacactgtctcattattaatttgtgaatcttaattatcttgagattgagcagcaccttaagcatcttcccattgcatcctgaacacaacagctgaaacggcaaaacgcttggccttggaagccaccaccaatattagggaaaccaccaccaatattagggaaaccaccaccaccaccaatattagggaaaccaccaatgtaacccccgccaatgattgggatggaaccaccaatgtaacccccaccaatattgcctgggacaacaccaccaatgaaattcccaccaatgcctgggatgctaagtttgctaacatcatgaataccaccaactaatttggcatcaccaactctatttgtctctcttactacctcacctgcaaacacattaacacattaaccattgtggatagaaaaatgaatcttgcacacccattaggcattaggtgtatataatttgctagggaagagaaagataagagggaaaaaaagaaaatgataaatgtgattgatgagaaagaaaaaagaattgaaattttacagtagataaataatattcagcttagggatttagaaaaaaaattaaggtgtcacatgctaatataaagccttaaaaaagacaataaggaccaaaattaatgatattgtatatttttttagagattaaaatcgaaaaaatagttttataaggacaaaaactcaatctttggattttataggaactaaaaagatattaaacatgaaaattaataaagaaaaattaatatttatagtctatgaaagtacgtgtttttttttcttttcatccatgcaatttattttagaaatggtcattgtatattattttttttgttttgctccttattatattttgttttagttcctcaaacatatnnnnnnnnnncataattatgtaacacatatttaaacaaatagattattaaaacatttataacaaaaatacattagtaatatcatttcataaatttattatgtttttttttttgtagtttaacattgttttaaaagcttttattaatattctcttaattcaaaatactcatgagcaaataaggcaaaatgatatatagctcaccctctttcaaattcctggctgccacctctgaggaaatgaaaaggagcatggccaacaggcctgtgataagtaatgctatcttcgacttcaaacccatcttccggtaataaactacaatagattaactcaaatgagatatgtttggtaatgaaggatgagaatttaggggagatgtatactctatatataggaatggaggagggaaaattgggacctttctcttaattcgcgccgtagcgtattaattcaatcttttctagagttaaaaaccgatttgttcttgatcatctccagctcaatttccttctccattttcaatggtaaaaatttgtaggctatgaaattgaagcacagcaattattgtaagtgactacgtgtatatgctatgtgtaatggaaggtagagaagtagatacctactagtttgatagtttgatatcacaatattgattttatttattgtaaagacaaagttaaatgtagtttcccaagtatgtttggtatcgtttttaaataaaataaaattttcattttagtaatatatatatatatatatatttaatacaagtcttttaagatggatattagtaaagtaatattttaattataattaaaaaatagcagaaaaatactttaaaagctataagttttgtgctatttatttaaactatacgtcaaataacttactagtttgatatcgtgatattatttttacttaccatgcataaagtataaaattatttagcaattgagttggtataaatgtcccttagattgtttctattatgtaagcggacccctgatgggtctgatatcgtaatattattttcttgtactgtattgccatgttttaactaagggtcacaattcgtgccttgttttaataatattagtctttgcctttaaaaaaaaagtattttcggttttgttttctaattgaaattagactctatttcattaatgtatatgttgaccttaaatacgagcctttataaggtggattatcaaagtgatgcaccggatgcatgtaaaataatttaatattactgtttaatcataaattatttttgataattaaaataattattataaaaattaataaataaatatatatatatatatatatgatgatttgtttgtgattgaatatcaatgtaaaaatattttaaactaccaaaacaaagtctttttcctctaaataaaacggttatatgtatactcttatgatggaatattatgatggaatatatatatatatatattgtttttatgagcattactagcaaatttagttgtcttcagtaccatgtgtagattttttgtgatgaatttcaaacacaaaaagttgtggatgcatcgatcttgacaactgattgtgatggtgtgtgccttgttaaaaacagcaaaatcatttctctcaatggaactgtcgaatttttgtatgcatggatcctcagttttcactttgaccccttgcttccatagttgaatgtggttcttaaatatatgaggatctatcatattttatattgttcatttaaacgagaggataaaggtagttttattttcaaaataaatttatattacacctaaggtaagatagactacacagaaatctttacggggaaatataatctatatattaatgtcatacagtataacacctaaatttttactgtttttattaaataacattaatttcatctttcgtgagtgaaaacattaattcaattataaaattcaattaattagaatttatgtgagttttttggtaagtttcagccattgttctaaaagttagatcgactaattgactagtgtgacctgaaactagtctattgaccggtccattaactccaaacaacctagacatctcagtacgtatcaaacaagtccaaaatagtggtagaaaatcaatttgaatcgatatatttttattttattttttaatttcatcaaaaatatttttaagataataaaaatgcatatttaaataatttacataaatataaattattctatcagttattattatctttttatcttataaaaatataatttcattgtttatattaatttacaatttttaatcttaatttctcattatttatattattttattacttaatctggtatagcaacagtttgaccaaaaaataccatttgttcaatcatggtttagcctcggttgaaccaatacaatctgtgaactctagactaaagaaacacttaattaatacttacaatccttcatttgacgtcttatggtataataggacaattatatacattaatcatgattagagagtgagattacacccttttgacgaaacatctttctcacatttggtctaaagtcttttagagaaaagattttggtgataaggatccaaaaatcacatgggaggcaacactttctttattcaattaaaagttcgctaattcaattaagaaaatggtttgttttggtttttgtgtggagggctgttaattatacaggtaatccgtgaacttaatttgattcaaaatgatttaagttgaattttttaagtatttagattcaattcaatacaactcattcaaatacgttcatatattaattgaattacgagttttaatatttaaatttaagaatccaactcattaattatttaatttgtttattacaaatattattattaaagtaaattacactaatcattttaaaggtttcatgaaataccataaaaattttataatttaaacatttatagcagccttccttatagaaaaacttttcaaattaacatttaattaatataagagttgtcaatataatatttttaaaataattaagagattattatagttgtcgtgctcgtggttgtcattattgttagtcataatcatcgtcattattattaaacatattaatactacaattaaaataataataaaacctgaaaagaaaataaattctagttacaatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattaatatttaaatttgggttaattaattgtatatgtttttttctctaaattttatcaaaatttaaatttttaattcctaaataaaaagttgatcagttttaatccttgatctttttgacccgtcaataattttattcattatcattaaatatagccttatgacatatcattatttttattattatttaattatattttacgacgattatcttcctaattgttaaaagtcttcaaaaaataattagctaaagcattcaaaatatattaaacaatttttgactgataaaaaaaaaagccgattgttgcttgcctttatttcttatcaaaatcccattcaaacacatcacatgggattatttcaatcaacttgaatttattttcggagaccaaaccaagtaaaactatagaattatttcaagcaacatgttaatttattttcaaaaccggtcaaggctaaatcctttacagcggcactcacaaaatctgcaatctgaacattttcatacaattatgttaaaaaatttaaaaataagaagcatacatgaattttcttttccgtccaagcaactatgacctcttcacttatctcgtgattattttcaagatcacattcacgcctttcaagcaagttccaaaattttggttgtgtaagaaaaatccctatttttcggttgctaaagatttatctcttcgtcaagttttttggcttagggtatttgtttttgagcgagtcaactccaaaatgattctggggttggaatcggtgctgatgaatcagtcgtggagaacgttccggtagttaaggaggttctgtatcttttggttgagaccctcctcgccgattttcacggtggcgtggtggaggagtgtgtcgttgagccgccacggctgatggtggatacaaacacgatcgagattcggtcgagcttgatggagggggtgatgtcgtggcgcacaatggcgtgtaaggtgagtgcaaagagagggagcgaagggtgcatttcatttgggagggttcttgagggataataaatgaacaaaaatataacaccaagttttgatctttccttccaagtcctaacctttccacaatctaatgctaatccatcaccatattcagaaatcacaacgaataagaaacacgaaccaacgataaacttcaccgcatgccaaatcgacccacttgcagaggcggagggaggggggctagagtgggtcaccgtttctctaaaattttattaaataaattttattatatatatatatatatatattaaaaattaaaaattaaaaaataatttaacaataaaaaatgttacattacataatataatatgatataatatttttaatattatattaaaaaataagataaaatattttttaagattgtattaaaaataagatataatattttttaatattgtattaaaaatatgatagaatatttttaatattgtattgcataatataaaatatttttaagattatattgcataatataaaatttctttaagattgcattgcataatatgataaaatatttttaggattgcattcaaaaattggttaaaatcatatgcttaaattaatataaatagaaacatatttttatgttgatagtatgcattccattccaaataatattagagctttagagagtttatgtttgcatcatcgagagaattgttatgagatcatatagaagcgtttgataagtctgattcttcactctccatcagaatttgaaggtacttatttattatcatagtggagttgtccattgaattgattatccaatttggacattgtgattttttatccaattaggtttttcacgctaaaactgattctgtcttctttatctcttatcttcatattattactttgagtttgattttaaattatgaattattttattaaggctcactagactttgtcagcttgttcatcaacccaccttgtttacaatttgtctgtctgtgatttgcggtttgcatctttttatatattagatttgtattgtcttcaaagtacttttatttatgatataattttttttatattcacctcctctcaataaaatttctggctccgccactgcccacttggagagaaaactgaaaccgagctcagaaacattgacactggaaagaggaacaactaaaagcaaaacccattgaaggaaaaggccttcattgttttcattcacactgttttaatttttttatttatttgtgtttcaaatggattttgatttgtgttttgaggatgtgatttgctgtttaaagtaatttctgatagtttcagcagtgagaagttaaacattaattaagtatttttttagtaattttttaccatcaaaaaaggaatcaccttaaaatataattaaataataataaaataataacatatcatttgttaaagattaatcaattttttattcacggattaaaagtgaataattagaaaaaattagagaacaaaaacataataactccttaaattttaataaggtaactccttttctaataacaaaagcattgaacttttttactttgtatctatgatagtgaatgtaattagtaaatctcattatatattgcctcttccacaattgagttatctttataaatattggttgtagtatacattcttcgtcgaccacgatactataatcgtttatttttctcagaacgaaaaaaaaaaaaaaagattaggctatttgtatcacatccataattttggcccatattaagccgttgttaatctatagttttttttccttccattttttcagtcttgatcgatgctgctatagactatagagtatagtccattaacacacgtttttttcggggttttttttgtgaatacactttttattttcgttgattccacttttaagacgtaacctatttattttaaatgggaacaccttaatgaagtatgtagttaattatctccctaaatccatttaatgttgttttactaataatataatgactattataattataatataataactattattataatttgtatgggaagaggagttgttccaggcattgcagcatttgctagattcagaaaaattaaatttagacatgaatgacagatgtgtgtagctgttggaagcagatggggtgtattaattgagtggcttcagcatacaaaagcttgcataatagaaccaatgtgacacttctgaatgtggatgcgacgctgccgtggaattcaccggttcctttaaaggtaattatgtgtttaaagggaattatgtgtttgttcttagttacatataagtgtttttaacacttgtagtgaaaaaaataagatttattttgcatttaaaatatataataataaaaataaagaaaaatatatttgtgtatctaaatacacttcttttgaagaagcaacaaaatttttctttaatagtgtgaagactttacgtatattcacacagagatcaatatatgtcattaactctttgatgagtgaaactctaaaaagcaaactatctttttacttttcaagtctaaaactaggctttgaacttttctattttgtgtctagtatactttgttcttaggtagatacttttatttataatgttacatatatatgaattttggcattttccaaaaaggagagatttcacttaaaataaattcatatatctttatatttatatttgaaaataaaactatttcatatcttttttatcttaagaaacttcttgatataagacaaagataattctcaaataatcacannnnnnnnnntacttcttaacccgtccgtataatatgacgtaacatattttaccttcaagaatcaatagaagaataatgtaatattttttcatcatttacaactcaagattaactctaaagtatagtgttactgccaaactctaataaattaatatattttatttaattaatgaatgacttaaggtcttaattctatcatagttcaaaactcattacctagagtttatgaattttttttttattaataattaattctacaagtatttaatcatattaaatattcattcaactagtactctaaagcattaggtggccgaaattaaaatataacaaataaattattaatcactaatataatttcaggtcaaagaaaactatatatgtcttcttgagaactttctattaacatattaaggcaatattaatcataagaaattttcaattaaatcagttcaacgatgacatccacatatacattatctatatataatttaataaataagatttattaatttttatccaataaaaactatttcatatatattaatctattcgaattattgttgtcctattcagaataatcatacaatcaaaaataatctagattaaaattataaagaacttatttttcagtaacataatctttatcatgataacaaattttttattttaatcaagatcttgtcaaattaaaaatttaataaaataataaatatattaataaaataaataacaattttttactaaaattaataattagatattgggtatatacatttattccaagcacttttctgaaaaataccaactaaaataaacttacggaggagggggtgctatgaaatgaagcccatgttgctgagttgtgggtaggggtatgatatattggtatggggaggttttgggttgtgctgtaatgtttctatttcaattcttggattatgctgttctacttttaggcactctgatacatcttctatcagtatgtttggcttattaatatatttttgccttttaaaaaaaaactaatatcataaaattatagtaatgttgtaatatattaatttatattacaataacattgtaatattatttacggtcaataaaaataaaaaaattggttttaaaaccagttttgttttgagaattttgttttaaaaacaggaaatcaaaagccaaattttaattagaacaacatgattaattaaaaaaggtaaccaaacaagttatatatatatatatatatatataatttaaaaaaacaaaatttattttataaaaaacatatcaaatagccctcatatcttggtgattattagttttttcttagcatcatcgagagataagaatgctcctaattataaaccaaagattagaattgagttgtatgtctgagatatcattcaaattttatcaggcctttttagtcgagggaatttaaatgcagcattgaccttgttcaatttagcatcggcttgctaagttttctgctttctgaattcgattgtaaaatgacaatataattatagaaagacaaacttaacaacagggaggatgataatacatagtaacatgacagaagtaaaactcactatttattacaaactatttgtacagtagatatttgagtttgctcttaaacctatcacatagtacggcgtattattgatcattaattctactagtgaaatatctctactgttaagaaaggtcgacagaaatgacatgcaggcctccatgttgtctatccatgcctctcataagacgagatttattcatgaaatatattattaagtacatatagaatcacactgtatctcatttatatgtaggtcttatggtcagcagcaagctaagcaacctcttgcatccccataacaacagccataacggcaaactgattggcctgggaagccctgacgagggaagccctgaccgggaaagccctgaccgggaaagccttgaccgggaaagcgttgaccgggaaagccctgaccgggaaagccttgaccaggaaagccttgaccgggaaagccacgaccaggaaagccctgaccgggaaagccacgacctggaaggccctgaccgggaaagccacgaccagggaagacaggactaggtatgccacgaccagagccttgcaaccctccaccaactaatttggcatcaccaactttacttgtctctttaagaacctcatctgcaaacatattaactcttaacacatgaaccatgggaaaacgaaggggaaagatatctaggtttgaatctctcactatcaaaaattaaacaattaataattaatatttattgataaaaaaatacataaagatagggacaggtgcaaacgagaaagaaaatgattaatgtgtttgacagtgagacaaagagatacaaaaggaaataaagtggaaataaaaattgaagttttagaaaatgttggatgatagaatggaactattccgtcagtttttagaaaattttcatttatgtgtttttaaatctcaaaacaacattaattattttttgttaattaatttaaacaacaagatttttttctatcatattaatctacatattcattatgaaagtagaagtgaaaataccactgatatatatttattgtgaagaagaataaaaaaacatatgaacaaaaaaagatgtaatagaaaacttaataactattttataaggaaaaaaattattgcatgtataaaaaccttaaagacaataataagttggaaaagatatataatgccagaagggggggtgcattttttaccaaatgaatagaattatgcatgcatttaaggacaaatatatatatatatatatatatatatatatatataatccaaaaaattataaaatgtttataacaaaaatataaaggtagctagtatcgttcttttcataaattcatcatattcttaatttttttaactagtgttttaaaaacattcattaatattctcttactttaaaatactcatgacatgcaagagaatagaaggcaaaatgatatataactcaccctctttcaagtccctggctgccacctctgaggagatgaaaaggagtatggccaacatgccaggaagaagtattgctaccttcgtcttcgaatccatctttcagtagtatactacaagtctacaacagatctactcaaatgcaatatatatgtttggaaatgaaggatgagaaaattagtgcaaatgtatactctatttataggaggggaggagggagaagttgggacctttctcttaattggcgccgtagcgtactaattcagtcttttctagagttaattaagaactgatttgttctggatctccagctcaatttccttcattttcaatggtaaaaagtggtaggctatgaattgaagcatgtaccgcaattaattattattcgtcaatacgtgtatcaatttgctatgtaatgaaaagtggagaaatagacacctactgtagttttttttatttatgaaatatattgtagtttgtttttacataccataatatcatttttatatatcataggtagaaaataattcaaaggacaacgttagatacgttttcttaagtatttccgaatttgttttctaatgaagattcaaattttattttaattagtatgtaatagaaatagaagaatgtgataaaaaaatatttattttagtaatctgtataccgactttacttttaataagagcctttaaaaggtagaccaccgaagttaaattttaattctaaaccaaaaataacgtaaaacaacttaaaaaaatgtatttggacaaggaattctaaagaggtcattcatttttatagagaatctaaaatgtgtgtgtgtacatggaatttagaagaaatcaagaaatttatgaaattattttcactacttcacactaatattttagtatatatgtacattgcacagaataaatgatttttttaaactaaaatttataataaataaatattttaaatatataaattataatataacttttttacaagatagattatatttaattaaaatttataataaaaaatattatatcaaattataactaaagatatagatattgaaagagataagaaattaagttcggtaattcagctcatattaaaaacataaaaaatatatcatatgtatattaggaaaatatttaaattatttagataatatatataggatagaaattcagttcatatatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgccaaaaaaaatgttatatcgttaaaaaaaaattgaaaccattctttctaattaccatgtgtgacccgttaactacatatataatatttaacggaatattagatgaccatctactgaaggatgctcaactctgagttattgagcgaaatttatttatttatattaaaaaaatcaattaaatggatacaaataattaatgtgtcaaaatgaaggttgaatcatttgataaaaataattttttgataaattttacttatcttcaaagattatattttttttcacttcatttaaataagagttgtaaccatatggaatttttctgtttcttagtatgatttttatcatcatctctcgttgaatttcggattagtagcataaggattaatatatatatatatatatatatatatatatatatttaataacatttgttatcacacatatgaagataaaaacataaatgttaaaatcataaaaatttaacctatctaatcaaataaattacataactcataattgtcttttatgtgatcttatattttaaaattgtctaatgataatctcattgtcaatgctattgaattttcactagaccagttgtcaaatttccaaattcattgccaaatttccattaaactcatcgtcaacttatgctccaactagttgccaaaatcattaaatcaatagggacaaaatgttcctctttgtaaatgtgttctttgagtcttatttcgataattaattagaatgatatgttaatttttattcgctggagagtttgaaaaataaaaagaattgaaactcagaaattgaggataataatggattcaaatatatataaacatgagagaaaaatacaaaagctctaaatatatnnnnnnnnnntatatttataattttttcaaagtctagggtatatttacacacttccaatcaaggacggatccaaggggataagcatgggttttctcccaagactctttatgtataatgagaaaaaaaaaggaaattaaaataaaaatgctaatagaggaaaataaacaagaaaaataggatttttcatttaatattttctaaaattctttctaatgggtccttttttagttttacacataaaattaataataaatactttttataaactaaattatcatttattaaaatagctatttattagaaattaaatattaaaataattgtataaaacaaaattcgtccccatttataatacattcctaaatccatctctactcttaattcaacataggcgtgaccattttgggcgggatatgttagtgtctatgctaccacattcaacatattacacttaatttgaaaagaaatctaaaataaatgttatttatatatctgaaaatgaatgttaaggaccaagattagcgatttttatattttgcatacataaaactaaggaaatatttttttacaaaaagtaaaaataataatttcaaattctagaagaaagaaaataaaatataaaataaaaacctaaataaaaatttattcattttatagaaacaaaaatcatatttatctttttaacttaatcataaaatgccaaaattaattaccaccgatgggtagatgatgtggtgtgagcagacaaaatagagaaaacacagatcaattaattttacgtacacgttacaatatattttcttccaagtttgttttttcaaactctccattgagaatcctcttgaaattaacttctgcacagtataatttcaaaatttatttttagaatagtaacttaaaaatgtcttgaaattttcaataaagtcgtggcttatgtattatttatattcttttataaaagtcgagtaattaaattttttattataggtaaaaaaaatttacattaaacttttcacaattgacaatcctaaacaagaatgattagtaaataatttttattgttttataaaaaaatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattattattattattattaaatgggtttttatgaactagcttttttaaacaataaaaaagtagaattataaacatacccctctctctatatatagaaagagagaggaatgctaacagtttactccttttaaactcaattataagtcacacaaaaagcttcggtgaactcaaataaaagtaattgttaattacttaccctatttaattatataacttcaaacatgccctttaaattaattaattgagagtatatttcctaagtcttgaagaggtagtccttaacataattttttaatacacttttattactgatttaattattgaaaattataattttttgtatgtctcacccttttatttagtttttaataaattttattaatagtagtagattgtgtattggaaggagtgttgtcgattcacacaaaaaagaaaggaatgattgttgttgttagcatccctctctctctctctctttatatatatacactacaaaaaaaatgtttagcgaccgctttgtcggtcgctaaatcattaaattcggttgctaaaatagttagcaactgaaatgacaaccgaattcattttgtcgctaaaatcgagtccctaagtccttagtcaccaaattcatatttgatcgctacttagcgaccaaataactcggtggcaataaaataaaactcgattgcagtgtatttggttgttattttgcttggcaccaattctgcaatcgaaacatgcaaaagtaaatttggtcgctaacaattaataaaattttaagcataaaataaattaaactaatattcgatttctattttcgtcgttattgaattaatttaaaacaaattttaaaaaatttcattcggttgctaattttggtggctaagttataataaaatgtattgatataattcggtagctaacttggtcgctatttaataattaatttcagaattaaaatgcagtttggtagctatttgatttttaatttttaaatataaaattaattgaaaatacaaccttggtcactaaaggaaaatatgcttatttttttccttttcatacgttacattttgacttgctcaataaatattgactgttaatataattattaattaaattgtataatcaaatttataagtaaaagtggacattcataatgtgtaaataaatctattaacaaagttctaatttaaatattgataaagttcaaattcaaagtttattaaaatgcaatgtcagagaataataaagttcaaattcataactaatatgacataatcaaactaaaataaactataatcaggaatcaatggtcctttgacatgtcatgatgacgatcaacctgagtatcgtcaacatggtgcacaattccatccgttgtggtagtcgatggattaagtaggggtgtttgcgggtcgatttggatcggttttgatcaaatttaggatccaacccaatcaaatttgatcggttcggttttcagaagaaaaaaattaaaactcaacccgttcatgaacggttcggttcggttcggatcatcgggttatccatttaatatttttaggactactattttatatcacgattctttcaaatattctatacaattaacacaatattgattcatttaataccatcaacataatattctaaaaaagacttataaaataaattaaaacaaaagattttgaacaagatttactataatagtctgaatcacaattgtttcttacaaaccaagctttgttataaccaatttattcaagtgttataatcaatttactataatcgatggatagattaagagctgacataatagactgaatattcaagtgttgtaatatacgttgtatttgctaattttgttgaataatttgctcaacatcaattgcaacatcttttcctcaagtgtcttctccatatctgcctttgccaaaagctcagcatttaatttagtaattgtctcatgcatttcctctatttggtgttctacaagagcaatataaatagatgaagctgattttgagcaactaaaccttttgctcaaagtacctagtccatacacattgcccttgtaatttggacctcaaacaacatcaaatatatttcattatcattaacagaagtacgagtgttaggagaatcttgtgtagatgtacgtttctctatcgaatattataagattttgtctcgatgatgttgatatttctcctgcaatataaagtgagatatgaagataaattattaagtataaacatataaggattactattcaagaaaatcaccactaatacctgaaaaaaaaattgactttaatctactatagtaggcttcaaagtttatactagtcaattacaaatatttttaaataattataagaaacaaacaattattttgtacaaaaactaattaaaagattataaataagtatgattttttatttatcttaataaaaaatgtaaatattggtttgttaatttaaaaatattactaatatattatttcaatacttttcaaagtaaaaaatgtatttaggtatatgatattttttatgatttaaaataaattaaaatttagtttgtaactatttagaaaaaaacacatttttcgctaattcatcgctaatcttagattgtaattaaatagcgaccgagataatttcaatcgctaccagcataccatagcggctgaatactttcagtcgcaactttaagtcaatcttcggtctctataatactattttttgggatcaagacaaaaaatttgcttctatcgaaaatgcgcatgcttcttttgttgaaataagtataaatggtttggttagatatttcttaagaattgacttagtgaaccgccctttccccttctcacaatattaccgaacttgctcaagaatgaatggcacttcgaagtgcctcacgttgggggatcggcaggaaagaatttggatacaaacattaattggtcgtgtattagcagacgatatatacagaggttcacgatgcattgccattagaaatctctataatactattttggatagacagcgatcaaattgatcagtgacacttcgtttcgatcgttgacacaattaggtcaccacaataaattttggtcgcaaattcgctctcagttggcgatcgaaactttcaatagctattgcatcacgaatagcgacctatagttttcgatctctaatttcggtcgctaaaatgcatttttctagagttgttactagtattgtatatttgcattttttaaaagaggagaatcgtgtatttatcacaaaaaggaagacaatataatacttgtaactttttgaataaattctattccacaccctctaagattttatcttattattctcatatccttcctttattagtccttacaataaactctttaacagtttacatgttattacattctttcccacatgctctaagttctaagcttcaagagggctttaatggtgggtgaagaaaaatctagttccaaacccttgaatcttgggttgaagatgagagaaattgaaagaaattcactgagtgtgtattgtgtgtctacggtgaagagaaagaaaagaaagagtggaattggcttgcttgataagttttaataagaattgccaacttcatgacaagtggccaagtaatttgtggtctagaaaaattatagttagatttaatttagttgtaattgttgatgattatccttaacaaactcaagatcattcctatgtaatgagaagtcaactaagttaccattttagttggagtaactaaatattataaaagaaaaagcatagaaaaattactttttgttacttattataattactaaaactaattatgtaatttaatttaattttttactttgtaaattattagaacagcagagaggatgatacatataaacggtgatgatatatagtaacagtagaagtaaaagtcaacatttattatatgacaaattatttgtacagtagataattgattttactcataaacttaatgacacaggcacaaacgagcgacgacgtaatatatattcaacatttattatatgccgctatccatatgtcatatgtgcctctcataacacgtaagagattttattcataaaatatgttattataagtacgtagaattacactgtcgtctcaactatgtatcctccaatagctagggcatcaacaccttaatcaagcaacctctttcactacatcatccccatctcaacaacctttacggaaatcctcctgggatgccaccaccaccaccaaagccagtgcttgggaagccgccaccaccaccaccaccaccaaagccagtgcttgggaagccgccaacaccaccaccaccaccaaagccagtgtttgggaagccaccaccaaaactaggagtgaaagggaaaaatggattagaggtgggaaagccgccgccgctgccaccaccagggtagaatcggtagccggggaagccagggaagaagccggggaaacgggggaagccattgaagccgaagcggaagccagggccaccaccaaagccaccaaagttgacgccacgaccaccagacaatccagcaccagtgactggggaagccaccaccaaggtaacaattattatgatcaaaagaatataaccccttatattgcaaacatctttttaaattcaaaggttcggtatgaaggttttaaggatatcaaataaaaattaatcaatacaaaaggattaaataatattttgttaattagtatatgtaactacacttctttttgtttttcattcctgtcatttttttaaatggtcatcctaattattatttttttcattttggttctttttatttggttttagtcctcaatatatattattttagtttttataatatttagtacgtgtatttttttaattggttggtaatatttactgtattttgaattagtctctttgtagaaaaaataaaaagaaaattatccacaattataaagtcaaaaacaaaaaaaaatcaaaaattcaaaacaaaataataaagaccaaaataaaataaaaatcgcaaaaggataatttagaaggaaaaaatttaagaacagaattaaagcaaaaatataaaaagaacatatagttacaggacccaaaacatataattcaagtgaataaagaaatcattaaacattcataacaaaaatatattagtaatatctttagataaatttattatagtttaattattaacattcttatagtttaaactactgaagagaatataaggcaaaataatattatatagctcaccctctttcaattctctggctgccacctctgaggagatgaaaaggagcatggccagcaggcctgagataagtaatgctatcctcctcttcgaacccatctttcagtagtaaataaactgtaacagatctactgatcaaatgaaatatatttggtagtgaaggatgagaagattagtgggaatgtatactttatatataggagaggggagggagaagttgggacctttctcttaatttgcgccgcaatgtattaattaattcagtcttttcgagagttaagagccgacttgttcttgatcgtctccagctcaatatccttctccattttcaatggtaaaaagctttaggctatgaaattgaagcacagcaattattgtacgtgactatacgtttatcaacttgctatgtaagtagacacctactgtagtatgctatcatatataaaatcatttttatatagcataagtataaaataatttaaaggactaaatcaaatatattttcttaagtattttcggagggtttgctttctgattaaaattaattaaaattttattttaataatctatatatacggacctttaatacaaagtctttaaaaggtgggttacaaaagttaaattttacttttaacaaatttttttttttaaaactatacaattattaaggggattacaacaatgtacaatgtacatgagttgttacaaaaaagttatcatgtgtatagtgtaaaataattttaattttacagtgtcatatcataaatcaccattatgataaatttgttgacatctaccataactgtttatatattttttgtcttaatcattcaattaattaggaaaaaaactttgactaatctaaaatttaattgaaaggtaagtaaaatttgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatgtatatatgtgtatatatatatatatatatatatatattaccataaaatgaatgttgggatcaaaattagtgaatttagattttgaatatataaaaattaaggaatttttatttaccataatcaaaattcactaatttacgtagactaaaaatagttatttcaaatttttagggaaaatgaaaatcatatataattctttcaattacatgtaaaaggctctaattaattaccaccgaatggatagatgatgtgatgtggtcaatcgaaacaaagaaaaaacaattggacgaatactcaaattgattctcaaaagtagtatgagacactataattttagtccatgaaaataataacattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttttcatatatttttcatattgtttatacatctttttgacccaaacactagttgatttttatggtttttatatagatgtatctaatgagataaatctcgtatcttgaatcaataaaaaaatattcaaaattgtattaaaaaattgaaaaaatcaattctttaaaggattaacttatcatgaattaaataaagagattgttttagaacttttaaacattaagagaccaatttaaaaccaaaaaataagttaaggaaccatttgatatgtcatgaaaaaaataaaatcaattaactttaggtacgttgcaatatattttcttcaaaggtttttttacattctccattgtgattccccttgaagttttcttatacagtataacttcaaaattcatttttagagcaacaactttaataaagttgtcatttacgtatatgaattaaactatttttttaacataataccatatatgaatcgtgaatattataggtaaattattttttaataaaaaatttctcaatcctaatcaacatgaattagtaaattattttattttattttattttttatgaagtccagtacggaaaatacttgcctcggtatttcatccaccatttagttttaacttttatagccccagtggaattatggaagtcctaactctgacatttgattttttatataaaaagaaaactcgagtttcttctttatcttcataaaactaaaagaaccaagttaatttttcattttttaagacaaaattgtggctcagttgtttgataggttatgatataaattcagtcacatcctctttttttttggcaattacctcttcctcctacagactcctctcacatgccacattgtcaactagattgatttcatcaaccaacttgttaatttgtgtgtccaggttcccgaacacttccactccacattccacctcctttcatgtaacttaattgaagccccccaacggctaaagtttttaaagatggaaacatggcctattgtctatcttcaccctaaattgaaacctatagtaaaaaaaatgtggaatgtggttaaaattcatagtagaatacatgtacctaagtcctaatataagaaacttctttgatttagttaattactctttacaaaaggacaagagttttaaaaggaaaatgacatttgcatgcagcgctatctatcttcaccctaaattgaaacctatagtagaaaaatgtggtgaaatttctatatatgataatataattaatgtatggtctctaatagagagaaattagtcgtgatgacaaatggagtgaagtcaaagtgctttcgcaacatgttaaatcaatgtaaatcatctggtgagaaacttaaatatctctttacctttgaaatatatatttagaaaggttaactataaaatggtattaataactagttgtagtttgaaaagttgaagaacgagacaaggaattacaattggctctcttgcttgcaacaaggttaagcatagtggtcctagaggatgttacttctaacgactataatggaaactgcagactaaatggtcatggaagcgcaaataagagtgatagaaagagaattaattaatttaaaaagtttatttaaaaaaaaaatctaaagtttatttgaaacttgatatcaagaataaataaaatcatcaaaaatagaatctcaattaattgaagaaagtttttaaaatgatatcattaaatatagtgaaagtaattaaaatttatttataattaagttcgctaaaccttttatttttttcttataattgaatctaagagagagtatgttttgaataatgaagaatttttgtaaattcttgctcaaaggttgctgcaagagaatgctaactcttaataaccataaatataagtctccattccacgtacggtaatattatatagatagcattcaagtgtttggtataagccatgggacaacaccacggagttaattattttttttcctcttgtattcaaataaagagcacgaatcaaagccataaacaaaatagacagtaaaatatacctttttgtcattgaataatgaggcaaagtagccacatctttagaggtatacacagataaatataataatattaaatgtctttatatataacacgatacaaatttgtcttccacttgcactagagccgctcaaacctgtttctaatgtctaatgatgatcgatctagtatgcccttcatacttaaaatgcacaagaggtttagtcaatgggtttgcaacattatcattgcgcgtttgttttcactttgcatattttcttatctcccatgttctctcgatcgaatgagatgtggaagtactcaagtatatgcttacatctttgatgcaatctagaatccatagttattgctattgctccactataatagagacttataggtgattaattaattagttttttccttaacccacatatcctggtgattagttttaaatttcttagcatcgcttagctaaataaaaaggctcctatatatagactaatggttaggattgacttgtacgtgtagctgttatgttattcatagtttaataattaggcattggtaattaggggaaattaaatatagtgcagcattgaccttgttcaattaagcttaggctttctaatttgtccgctttctgaataaatagatacggttgcaaggataatttataatgacatgataattatagagaagcaaaaacttaacaacagagaggatgatataaatgatgatgatatatagtaacaatacaagtaaaacccacgatatttgacaaactatttgtacattacataattgatatttcagtttgctataaaaatcatcacagtgatcacactgtattttcaatatgacgtattattcacttattctatacttatgaaatatctctggtggtaagaaaggtcggaaaaaagatagacttccttgctatgtatccatgcctttcataactcgagattttattgatgaaatatattagtaagtcgtagaaattctacagtgtctcattttgtgggtcgtatcttcagaatatagggcaacacctaaagcaacctctgaatggatccccaaaacaacagccgaaacggcaaaaccttgggttgaagccacgatcagggaagaagccaccaccaccaaagccaccaccaaaaccacgaccagggaagaagctgccaccaccaagtaatttggcatcaccctcattggcctcttgaacaacctttcctgcaaacacatttaactcttaacacatgaatcacttatgatagaataatgattttttgcttacccatttggtgtatgtactttgtgagggaagagagagataagagggaaagagaaagaaaatgatatattagattgacgatgagctgacaaagaaagaaaaggatataaagtgatcataaaaattgaagtaagaaaaggttaaatgataataaattgggaaaagacacagtggggaaaggggagtccattatgatagaatgaataagctaaaaaaagctcatgtattctaaacatcttttaagttgaaaggtttttgttaacgagtgcttaggacgttaatttaacttgataaataaaaaaaatcttaaatattttgttagttctgaaattaggcattttttactactttttgttattgcaactttttaaaatgatattggtaactattttctacattttgatcctttgttttttatcctataacatatctatttcttattataatttctatattcgttggcttaatttcaattagatgatgtgaaaaatggtaaaaataaaaaaaatgggtacattacataaactaaaacaaaaataataaaatacaagaaccatttcaaaataaatatagggatgaaaagaaggagcaattgtaaggattaaaaaaatgttattgatacaaaagtattcattaattttacaaatgattagtttttactgaaaattttgtacacttttaatgaattccatcctcccaactatcttttaaggctgaaccgaatatcttgattataaaataaacttaattatactcatatatactaataacatggttttagcgataaaaatatatttaagttaataaaaaatataacacatgtttataacaaaaaaaaaagcattagtaatatcttttcatacatttattatatttttaatttttaactagagttttaaaaatatttattaatattctcttatttcgaaatactcacgagagtataaggcaaaatatatatcgctcaccctcttgaaaatccctggctgtcacctctgagcagatgaaaaggaacatggccagtggaataatgagtaatgttatcttcgtcttggaacccatctttcagtagtaaactacaacaaatctactcaaataagatatatttggcaatgaaggatgagaaaattagaggaaatgtatagtctatatataggaggggagggagggaatagttgggacctttcccttaattggcgccgtatagcgtactaactcaatcttttgtgaccgacttgttcttgatctgcagctcaatttccttctccattttcaatggtaaaagattgtaggctgtgaaattgaagcactgcaattattgtacgtgactatgtatacacacacacacacatatatatatatatatatatatatatatatatatatctttatttttttgtacaagtgactacgtctatatgctatgtaatgaaaagtagagaagtagatacctactgctatttaatttgatatcataatattattttatttaccataaagaattaaaaaaacttaaagcacaaagtagattcatcacttaaatgcttttgtatcattttctaattaaaattagaattttattttttagtaacatactttattagtctttaatacaaatttttataagatggattatcaagataaaatttcaattctaattaaaataaccggaaaaaatacattaaaaactataaattttgctctaatttaacctatagatacgtcaaataccgcaattaaatacaaccgctgaatgggtacgtagaagcaaatgttgtggaaaacaaaacaagaaaacactaaagtcaattaattttaaacgttacaatttattttgttcaaaggttgtcttttcactcctcctccatggtgattcctctttaatttttttacacagtatatactatataaccttaaaattaatttttagagcagtaactttaattttatttcatgatttatatatagtaactttttaacaaaaaaccatggttatgaatcatgaatattataggtaaattattttttacattaaatttttcagtcttaatcaagattaaccagtaaatatttttttattaatttatataaagtccagtacgggaaatacttatgtcgggtctttcattcaccaattaattttatatttaatttgtactctcaatagaagtcgtacatccgctattttgaagtttttttttttttaagaaaaaaaaaagaaagaaaaagtcaagaacacaactacacaagttttatttatcgtagaaaattgtggctgagttaccctgtttgccaaggtggcggtgctaagctcaaatgacattatatgtggctgttaattaattttcttaatggttgctaacagatttttgtctacagacttatggcccatcctccacggctttgccaacgctgtatctcttttaattaaaaaaaggtgttgttattaaagtttgttttttaggaaaaatattgaaaatatatatttctttaagaaaggatcttcaaaactaaatttcatattcgggaatatatttcctatagaaatgtgttacatctaactaaatatgcaaaattgacataactttacaatattttttttaccttttttaataaataataaagacaatctagtcattacaagaaaaattcgatatagcgactgaatttacgattcggaagaatccgtcacaactagagaccgatttagccactatttttgtttcttagataaaaatatgttaacgaccatattagagactgtattagcgaccatattagcaagtcacatatctgcgtggcccaataaataattcaagtcacacactctcataatccattttttctttagaggacctacatttctatctcaaaagaattaaacacattggttgctaattcattagcaaaaaatattttaaaatgtgaaaaattatctaattttatacaatatttgactacggatctaattggtggttaaagttataagaaatttaaatatatttgtgaaagcaaatatagttatgtgatattgtgcgaccaattttatcagtcgctaatgatactatcaataatatttgtgtaaagtctataaaaaatcaatttaacaaatataaaattgggaattttaacattataaatataaataataataacatgttaaataaaaaattattttactatattttataatgttataacttttttacatttttatataaaaagaaaaagaacataattgcgtcatagtgttcaccaccaagatacaaaaatgtggtgcgagagtgagaaagataaggtgatgttctcttttgttgctacttgtcatttctgtttagagtctcgatatttataaaattgttaggagtctgaattggcaagaaagttagtttcatcatgtattatgatcgtgttggaaaccctatattttggattgtgttttacatcgaatgctatcgactaccggctaggataacattctttatgttgagctcaggttaagtgttgatgtcaaagtaagggtgtttttcccctatgaagtataaggtgggttggatgtttaaggaagaagagaagacgagaatgatcatgagttcaatcccctctggtgacaaaaattaatattctaaaaatttaatatttgccaataaaataagtgttttttctgtttatatttatggattacttaatctgtgagtaaaaaaatatttagccctatgtattagatgttctagaattatgttagcatagatccaaaatgagtaatctaaaatgcatgttatatttcatattactcaatctagaattatgttaacataatttccaaaaagtagatccagaagtaaagtaacataattatggtgggagttttatggaacacaacatgcattctagattactcaataagaaattatgtcacatcatttatgaatcaacaattccaaaattaagataacataattttagatcaagtaatttgtaacacaacatgcattttgtattactcaaactgaaattgtgttagcataattctagaattgttgatatggaaatgatgtaacataatttcaaattgagtagtccaaaatgcatgttgtattctgtaatacttaatcggattgaaaaaaattagaagaacactaaaaaaaaattgctcattttaaggagtagaaatatatttaatccaaaaagttattaatagaaaataatgagttgtcaccaatgttttcttttaaaaggagcattggaaaaactctttaataaataaaaaagtcttcaaaaccaaatattagaattcatgagtcaattatttgtaagaaagatattaacatcctatatctgtcgtaaaacaattacttttagttaaatgtgtaaagttatgataatttataaatatttattttatcccttaaaaaaagcaagaaaaagcgtttaagtgttttttttatcacttagatatttttttcatcttgcaaatatgatgtttttcacttttaaatcctctaagttttgtttttcattttttaagtttaaaatattccttgtttagaattaacaacaatctcattctaaaacaatatttatattattgataacatgacttggccatgtatgacaaaagttaaaactgtcaaaacaagtaatctgactcaacccagtttaacctattggtcctagcatgaaaagtgaatagcctaggaaggctcctatatatagactaaaggttaatatgtacccgtttgggtaaggattgagttgtaagtcgtgtagccatgatattattcagagtttattatccatattttagttagggtttaattacgctttaggttcccttgtgctctactttctgaataaataaaaagatatggctagcctataatagaatttgtacaatagatgatattcaccaatttatttttctcttaaactcatcacacaggcacgaagacgtgtattatacattcaacaacactattaatttctacttgctaaatatctcgtggtatgaaagatcatggactcatgcatggatgggaatccatgcctctccagacacaagctgttttatttcatgaaattaaaatatctaaagtactaattaagtagaactgcatcgtcttaatcgtgagtcttgtcttgagtttgtgcagcaacagcttcgccagcgttatagcagcaccttctgcaacctccgttgtatgtccggccaccgcaacagccatagcgacagtagccaccaccacggccagggtagccgccaccatgaccagggtggccaccaccatgaccaggatggccaccaccgccatggccaggataaccgccaccgccatggccaggataatcaccaccattcccaggatagccaccgccatgacctgggtaaccccctccatagcctccaccgggatatttggcatcatccactccatttacctctttaacaaccaccaaacacagttagtgaaccatttatcatagaaaaattatgtttggacatgggtggaaaagttattatatggtcaatgaccactatatagtttacggtgatctcaatgcaactaattattatgtaaaactaatattgtttcaatttataaaaaaataaaattcaattatttgtaatgtaaaaattgtctcagatgacttttgatgtattactttgtgtgggaagaaaatgataaatgtaattggtggcctgagggatgaaaaagaaaaaagaaaaaggtgaacgtaaaaattgaagtgttaaataaatgaaaaatgatacaacacaccgaaaggagatttatgatccaatgaatataatttgaaacctcttgtttttgtaaacattttttaattttttataaactttttaaatttaaatattttaattattaacaaatattttagggatattaattgagaaatcaatgagtatttttttactaaaacattgcagtgaaagtactatagaaattacaacaaaaatatatcgtagccttcttttatatatatatatatatatatatatatatatatatatatattctttaaccactttaaagacaattgttaattagtatcttttactttaaaagaatcataagaatataattaactagagatactattaaatgatgtatagcttaccctcttttgcattcgtggatgccacctctgaggagaccaaaaggagcatggccgaaaggcctaggatcagtaatgccatcttcaaacccatctttcagtatagaagtttataaactacaacgaatgtattcaaatgagatatgcttggtaatgaaggatgagaacattagcgggaaagtatctctatatataggaaaagaggagagagaagtagaacctttctgttaacttggtagttgctatgtattaattcaatcttatctaaagagttaataagaatcgaagagttgttcttgatctccagctcaacttccttctccattttgaatggtaaaagattgtaggctatgaaataagcagagcaattattgtacgtctatatcaacctgcaataatgtatatcaacttgctatgtactgaaaaagtgaagtaaagacgcctgctgcagcctgctagtttatatcacaattttattatatttagcataaagtataaaatattataaactgtatgtcgaacacttaatccaacccatgcatcggttaaaaagactattttttatcttaacctataattaacttcaagtttgagtaaaatataattaaaaactccgaatataatagttctaatcgactccaacatgaatggtcagtaaaaagaaaaaacacaacactaattacacgttgcagtacgtttgcttcagctagtgtctgttttttcacattctccggttgtaattcctcttggaaaaaaaaaagcaaaaacatatattgactcccttttttttttaattcctttatttctaaatagaaaagttaattctctaacttttcaaaatttttagtccaattgtccaaataaatgccttgatcccatgtgacataacttaactgcaggtaatgaggtatatagccattaatctgaacgatcaaagcattaatttgaatggttaaaaaaatcactgattttgaaaattagggaacgaaaaatctttatttaaaattggagggaccaaaactgtaaattaataaaaaaatagaaaaataaaaattattttctagaaagaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatatatatatatatatatatatatatatgcagtacaacttaatttttggaacagtaactttaataaagtcgtgatcatttacgtgttcgatcaaattagtccaaaaagagaaccattcgaattagaatctagaatctccaataatagattgttaaccaaaattttgtatggtgaactgtaaggccattcttaatagtggttaagatgtattattggaattggcagtaagatctacctggagatttagttctttgcaaaattactaagattcatattgtttctcaaaaaaataattttcttttgtccatcgtgtacgataatttcttttttatttctatagtttctatttctactgggtagggtttcacttgaaacaataaatattttaattattaataaattgtatttccgttataaagtatttttaaaattaaaaaatataattaattatttttattattttaaaataatttttaaatcaatattaaaatgtgagtttcttgtgggatctacaaaaagatttaagatcttaaaataaaaggctaattattataaataatataaatttaattaatatttagcaaaagggggcaaacccaaaaatatttaggaaaatggggtgatgcaacacgcccagctggggcgtgtttaaacacgcccagatggggcgtgtttgctcccctggcgacacgtggcacagaaaaatgggggtgcagggttttcgcggttttttcgtaaattacggaaggctataacttttgatcgggacgtccgcttgagacgaaaccggtgggcacgcgctcgaaatcgagaggagaaggcctgggcaagttcccaaaggggacttgcccaaaaagttttcccaaacgaggcctctaagtgcctcaaaaatgcgattttgtctttcagcctctaaaaaattgctcgttttttattttttatttaatcagttagtgaattgcatgctgttttttattttttcaattactccattcaatttcgagtgctttgacataaaatacgcctacattggacattcctacaaaaaattatgactgtttaaagtataacagatgtaatttcttaagcatgtatatatacgtcaagcatatttgttgtttcttgtcgtattggatggtaggacaaattacatatataagtagagatggaaatgggttaggccatctatcaggggcttttggctgacctatttaaggctaggttaaatctttttgaaaaacctatttaaataaaaaggtcaggcttaacctttaaaaaaaacttattaaacctatcaggctggcttatttaatatatatatatatatttatttatttattgtaaagtagatttttaatatataataggctcgtaggtcaagccaagcttttaaattggctaggtcagacctaaaaaacactaggtcagacctaaaaaaaacctatgatagataactaggataggccaagctttacatttttaagtcaggcccaagccaggcctaacgacgtctgacctgacctgtttccacccatatatatacgtcaaggaaatactttaaacagtcataattttttgtaggaatgtccgatgtaggcgtattttatgtcaaatcgctcgaaattgaatggagtaattgaaaaaataaaaaacagcatgcaattcactaattgattaaataaaaaataaaaaacgagcaattttttagaggctgaaagacaaaatcgcatttttgaggcacttagaggcctcgtttgggaaaactttttgggcaagtcccctttgggaacttgcccaggccttctcctctcgatttcgagcgcgtgcccaccggtttcgtctcaagcggacgtcccgatcaaaagttatagccttccgtaatttacgaaaaaaccgcgaaaaccctgcacccccatttttctgtgccacgtgtcgccaggggagcaaacacgccccatctgggcgtgtttaaacacgccccagctgggcgtgttgcatcaccccattttcctaaatatttttgggtttgcccccttttgctaaatattaattaaatttatattatttataataattagcctaaaataaaataatggcatggcaacggggcggggcgggggcgggtattgcattccccgtccccgtccccgcccccaaacccgctccccacccccgctcccattccccgtcgggttttaaaacccatccccatccccgtccccgctgggggtcgggttttccccgccccgccccgcccccgctatttgattaaaatttaaaaaataaaaaaaataatataattttttttattgaaaaatcggataaaaaagttaattatgtaacaaaaaaataataataacaaaatcatatttaaaatatgggatcataattttaaaattacaaaacaaaatcaatcaattcaattaaaaaaattagaaaatagtattttttttatttttttattacggggcggggagcgggggcgggggcgggggcgggggcggggcgggtatcagtaaccccatacccgcccccgcccccgcttttgactatcgaggaaaacccgaacccgaacccgaacccgaaaaattcagtttttccccattaaaatcggggcggatttggacgggtacccacgggttcgagtcccgttgccatgcctataaaatatactattgaattaaaaaatttaagagatcttaaaagtgatgtggcaatgtgaagtccaccaaaaaagtggttaaaaatctaatcctagtggagatgtcctaagagcattttgaataaaagattttataagaagatcttagccttaagaaatcatcttactaaaattcatcattggagcatgatattaaatttacatgtagagatccaattcttgtaaaaaaattgtcaaaatctacatctatttaaaaaaattaattttttacttcctctttcttcacaaaattgattttcatctaatttttataaaacctaaaaaaaatggtttaagatattaaaataatctactaataaagtagaaaatagatgagatgttgaaaatgatataacactacaaaattaaaaaaaatggtttaagatattaaaaaaatggtttaagatattaaaataaattgcctctgctgcgccactagaaggatttgatgaagtgttggatacatgatggttcatcataataaaacttacaaaatcaaacaaatcctatctacgcctttatgtgcagccagtagttggatctagagaccatgttttctccaattgtcatatatatttaatattttaatatatttatatatatagtattaaatttagtgataattatttttttaattaatatgcttttaatatataaattcatttaaaaaggtatgcatttaataaatacatattttgtttataaattttaataaatatttatatttataatataataaaatttaatcatataatacatttaataattaaattatataagaaaaacttccatatttttaagcaataataaattagttcatttgctttacgtgcaggaggtggctgactaccgacgccaaaaataataatgtatttcttttggcttatatttttaattaagtattttagataatttaatataaattaatttaaattcaattacataattaaaaatccagtatatataaaaatataaatattttattatcatatatatatatatatattgtttctgaattttagtaactatatcatatttataatattataaaagttaactatatattatatttaacaaataaaataattaaatttatatacaaaataattcccttatattttaaacattaacaaaaataataaatttttaatgtacattttaacacacacacacatatatatatatatatatatatgatatttaataatttttattaaagataactatatatcattattggtaaatacaaaaattaaaagtatgaaatgaaaaaaaaatgtttaattacatatttatataaatatttatgctcaagtctacttatctttcataatttggttattttaaaatattttttataaataataatgattaaaaataaggtattttatgaataataattaaaaattggattttttttttatatatatagcacgtacgaagaggtaaagcaagtagatttgtttgattttgtaaattttattatcagcaatcagatgtatcaaacggtccgaagttgttgtagaggggctgcagaggcaatatgctagagagaatccgaacacctccttttgggggtagattagggtagatggaggagagagagaaaaaaagaagaaaaaaaatagagagaatatgataaatatgatatgtgatggaaaaatgtaaagagaaatagaaagaaaaatgggatgaaaatgggttgcaagaaaatgaatgagatgaatattattactcataagattatgttagaatttaaacacaagaaaaaattaaacacaatccataaaactaatttattaagtgtaaaagtcataaggatggattaaaacatcacattaaataatttattttattgaatgtgagatttctaacattatcattcttttaagaattaacattcattatgattttcactctatcaactcaccaatttagtattcatgagtttgcaccttagtccagcctataggtagcattttttgtaatccaactttctacgaaaaatatcaatttggacttaagcatataagaagagtctaattcaaaattctagtccattaagtgaaaaaatatctcaaaacttaaccaacgtccacaataacttttactatgtcaacattgataagatagtaacccttttgcctttaaaaactttactcatttatcagtatttagtgtgcacatgaatccaaatcttttttgtaacttgactctcaaagaaatataatggctcaaggtggactaagataccatagatcattggattaaactagaactttcagaaaagcacttcctaaaagtttttgtctttccatcaatgctcctccttgaaagatatggtttgtaataaccattttttatttcttttctggcgtacttaatagattttgttagcaccaaatcattacaattttttttttgtatttttactttaataattaaaattattttattaaacacaagtcatagagtccctatatctcaatgatttggatttgctcaagattgtcaagctaagaaggctcctataaagactaaaggttaatatatgtacaagctttggttaggattaagttgcaagtcgtgtagctagccatgatattattcaaagtttattagccatattttacttaagggaaattaaagcggcattgacccttcttcaattaagctttaagtttctgagttctttgcttggaataaatagatatggctatatataattaagggtcatctataagtatatgataactataaattaaaagaccaaacttaacaatagtggataaaataaacgatggtgatataataacgacagaaataaaaccacgatatttaagacaaattagaatttctacaatagatgatattcgtcactttaattttctcttaaactgatcacacatgcaaaaaggcgtattacacatattgaacactatttctacatgcgaaatagatctagtggtaagaaagatcacggggaatccatgcctctcgtgacaccagattttattcatgaaacatcttaagcattacgtagaactacatcgtctcaattgtgagtcttatccttagtttgtgcagcaacagcttcaccggcgtagtagcagcaccttctacaacctccattgtatgtccggccaccgcaacagccatagcgacaataccctcctccacgtcctggatagccaccaccacgaccagggtaaccaccaccgcgaccaggatagccaccaccacggccagggtagccgccaccgcggccaggatagccaccaccgccattgcctgggtaacccccaccatagcctccaccaggatatttggcatcttccactccatttgtcactttaataacaacaaaaccgacttataattagtaaaccatttaccatccaacaatgatttttgggaatgttgaaattattacatgatgtcagaccatcacgtatttaatttgggtcgcgattaatttatatgtgatacataactaacttatttaatttatgatttttttaataaaactcaattatgtatgtgttaattacatgaaaattatattgtttagaatcatcataatcccggagcaagtaattatagtttttctattgaatgtatatactttatgagggaagaaaaagaaattgaagtgataagtgtaattggttgttggaagaaaaagaaatatgaagatagaaaaagatattaggtgaacataaaaattgaagtgagagttttagatgataacaaaatatacactcaattgaaaaaatatacaaaatacagaaagaggagtctattatgatcgaataaataggattagaaacctcttgttttgtaatatttttatttatttaaaggttacaacactaatatatattttagggatgttagctagtatagaaattaataaatgttatttttataaaacaatgcagtgaaagtactatagaaattaaaacaacatattgttgcattctataatttttgtttactctttaatgagagtgttttaaagacaataatatttgctagtattttatctttaaaatattcataaaagtacaaggcaattaaaatgatgtatatataggttacgtaccctcttttgaattcgtggatgccacctctgaggagaccaaaaggagcatggccaacaggcctaggatcagtattgccattttcaaacccatctttcaatagtaaactagaaatgagatatgtttggtaatgaaggatgagaaaattagtgggaaatatatcctctatatataggaggagaggagagagaagtagggacttttctcttactaataagttggtagttggcgcgtaacgtgtatattaattcagtcttatctaaagagttattaaccgaagagttattcttgatctccagctcaatttccttctctattttgaatggtagtaaaagattgtaggctctgaaagtgaagcagggcaattattgacatgcatcaacctgctacagattatcaacttgctatgtactgaaaagtggtgaaataattacatgcatcaacctgctatatactatcaacttgctatgtactgaaaagtggtgaaataaagacgcctgctactagtttgctatcataattttattatatttagcataaagtataaaataattattgtaaactgtatgtcaaacacgtaacccaacgcatacatcagttaattaatacgagactattttatcttaacctatatattgttgaacacttacgtacattgcatatgttttcttcaatggttgttttataatgttcttctttgtaattaattctttttggaaagaaaaaatatatcgtatagattcaaaattaacttttgtagcagtatctttaattaataaagttgtgatttacatgttaagcacaagtataaatagagaaatattttatatatatatatagagagagagaatttggaatctccatcaataggggttaaataccggtaatatttttacatcaattaattataaataaaatttaatatcacactttaattaaaaatattaagattctaatttataaatctttttatttatataatattcaatattttcatttttatccgtaaatttctttcacatgctaagtattatgtgaaagaaacacatgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttatttgtatactgaatcttcttacctctttatctatttcaatctatattcttttatctttatccataaattaaatttcagtaatttaaaaatatcaataaatataaatgatcttatatcaaatttaaactattcaaaagatattaaaattatttatttatcatgataattatacacatttttaacatattatttttaacccatattttattattttatcattttctttatttgtccattgaaaaaacatcaacttgcctacttgaattttaaaagtttaatttttttaattatattctcagcttacctaattttaaatagtgtaatttatgcacatattataaatgataaaatataatgaaagtcatattaaaaagttaaatgtcagttacattctttagtttatgtaatattttcttaagtgaataaatgaaaagaaacaaaataagtaagtatattttactaaaatttatcggaatttacaaaattaatttgtgaacctcattagaaaaataaaaggactcgtatataaattcattaattttaataaatttcagtaaataatataaaatatacaatataaaaaaattaagatcaaacttttgagtcaatgctaaatacaaagtaaaaatataaaagatggaataagctagtaacttttatatttaattttagtgcaataaatattttttccaaataaaaatataagtataatttttaagcattaatatttacagtaacaacatctcatcagaaataatgttaaatgtgtttttttaattatttattaagagtataaaaaaatagtaacatacagtactatatcaagaaaaacagtcgctttaaatattggatccgtggcaggaatatgtatttattttgccatgctgcccatgcagcaggtattctacgttatttagtgcgaaagacaattcaggccatcaagtcagacggtgatttagtgagtctttagatacccgtttaactcacgttgaatgaaaaaattgtgctttcaaatgcaagaacgtaaaagtaacaaggtacttactttgaattcaaggaacgtttgagaccggtgaatgttaaaacaaacacactaatgatcaatggcgcaaaaaaaaaaataaaaaaattgcatcgagtcttcctccacactccacatacctaatctctaacgtttcaaattaagtaaaatgctttaatgcattaaattcccagacgctcctgcaacacgtaccgtacaagtgttaagtgtacaaccaatgtgaatgtgatgaagtatgtaacctttggcttgtggctgtggctcatataatattgaatgagaaatccagtgaaccgaatctagctagatagcaactccatcaatggactcacgggatgggaaggacgaaaaagttggactccgttgctaacattatttaaatgggtaattatcataaataatgacccatgaacccactagcttaatcatcagctttcttttgatcctctcgatctactggtaaaatgtgacaagaaaataatcatgctgtagatcaataatggtgagaaccgatcactactagtacaaaaagtaaacgttttttttatattcaccaactatgcctagctatgtttggctttgcacttgtactaattattgtcattcactttcacttatttcatcatattattgttttttttttcagacttgataatgacttgtaattttgttttatgagactnnnnnnnnnnaaagggagtaattataaagctttatcagtgaaatccagtaaaaaaaataatttaataacatggtgcttcatttcacaaaaaaaaaaaaaatgaagagaaaattgaaattaaattcagatacatgtcgttattctgtatcccatactcttcacacaacacacttaactttgactatatattgatgcattaaatgtaatcattattgttttagcaatttgtagtcaaattcgctatatcttgcattcccactcaaccgcataagttaaatcatccacatgacttgtcaggctttctataacaaatgtcaactcaacgataagatcactcacattcacgaacaaaatgtaaacgtgtctgctgctttgagtgtctaaaacatttattttactgagtaattacttgataaaaatcaacaattactaatattttaataaattacaatttgttatatatgtacatttttaattaatttatttgtgattctcaatttatataagaagaaagaatatcgggttgagtttttttaatgtgaaatagtattagatttatcataagtaattaagactgaaatacataaattagtaagtttttaaagaagccttgtaatgttttttaagtgaggttgggacacacctttttagatttcaattgaaataatatgatgctaatgatggaaacctaaaatctcctaaatgttttgtgaatagaagggttgccctgcaaaaccgatactctacaatgagctaaatagaaggggaaaaaatgtaatttctacaataaaaaatcagataaaaagaaagaaagaaagaaaagattaaaatgagataaaagtataatttgtagataaaatagctaatgtaataaaaaatagaaaaaataataatgcctaaatgtataggcacaaatagtgtaattttttttacattattatccaatatttacaaaataatatataaggtaaatttgtttgcttaaaaaataatcacattaatagtcatactcatacgtagcataatttcttacatgttgatagtataatatatttttttatgctgacaatgttttaaaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaataatataacttaaaaaaaaaatcgaccaaacatatcgataggatagcatatttattttgttcagcgaaaggccgaacactaattccatattcaattagtgaaaaatgattatgtattaattccatattcaattagtgaaaaatgattatgtaaaataaaatttacactgtcacttaattataattcattatatacgtaggataaatttattaacatgtaaaataattattttaaagtaatttaaataataatttataattatataataatataatattattttataataataatgcatagacattaaattcattaaattaatagtgggttaaaacaaataaaataaaataaaagtaatggtggactaaaacaagacggaacgaccaaatcaaaactacttgtgggctaaaaacgagtggccgcaaccaactcgcttaacattaaaaatttctctaaattttaaaatagtatacaagaaacgatttatatatatatatatatatatatatatatatatataagtgtattttcctctgttataaaaaaattaaaaaaaggggcacatatttttaggaaaaagagtgatttttatattttttttatgttttaactcctaagagaggaattggataagttaattttcaaggagtgaaaataatattctatgtgtaaatcttttattttatatttttaacttcttttacatctcactttcattgaaagattttcaatttagtaatcaaatagtatatatttttaaagactcaaataacaatttgatgcctatacaataccttgtttttgtattggtcctttaaagatttttttaatctttgtaaatttataactttttattttagtctatgttgttaaataacaactttgaaatgatgattaatgatattaagagttcattaacttgtcacaatcattaagagagtatttgtttcaaagtttaatattacattctcgggaattatattccttgaaatactatgctgaatataatattcacataaatttttcggttggtatttgataatttcataaaactatttaattataaaaataaaaataaaagaagaaatggaaaaaaaatatagcagaaatggatagttaacttctatttccatggaaatatatatactcgattatccttcattatggaaataagaggtgagacaaatatgagtatatcatattcctacaatcaacaatgtctggaaatataattttaaaaagttttaacaaacatggaaatgtgatatcatgtgttcacattttttagattaatttgtaatatcttgaaacaaatacaactagtctgattggataattacatttttttaaaaaaacaatatttttaatatttttatatatcaccaactattttcaacatataatttaaaaatatagttatatatatgtgtgtgtgagattgctctatcagatttttttttttataacatatcaagacaacaaatttggtcacgttattgttacatgataagttaatgttattacagagtttgatattacaaacaaagttcttgaaaattaacattattaaattttcattaaatattgtaggcatgttagttgtttccttccttccaagctctcttatttttatttttctttcatgaaaccttatttcctccataaatattacgccttattttgtattcttttatatttgattaacaagtacgattttattttgtaagaacaaagcatgttggagatgctaattctttggaagtggctgagatgatatcgaccggctgttcgaacaattaggatgaaccctcaacttaatagtcaatagttgttgtctgcttataatgctcaagttaacatgagtacttgcaactttggcaaatttaaataaataatattttttaataaataatttgaaaaatagtgtaatttggaaaatattttgaaaaatgggattgtcaaacacgtacaaattggacgtgtttaaatacgcctgaaaaaataaaaaaataaaaattcgtcggtaattctgtcgttaaatgtttgcgaccgcaaattccgtctctaattcagtcgctaagtgtttgagaccacgaattccgtcgcaaaatgtgttagctactgaaattaacatatgactttaaaatcaattttttaatttacactataatttttttcaatttttgaaattagtgttgcgaccacaatattgtgattttttaatttttttaagaaatcgtttaaatatttatagtataattttgacaaatacatataccaaaaaaatattaccttattttgattatttggcaaaaaaagaatgtgtataaaataatatatatatatatataatgatattaacacaaaataatttgaattatcttaatttatataatccatcaattattatatataatttgaagcaatcattcaaaactatattagatatactatgtattttacgtatccaaaaatctattttatatttaagaagtctttgtgtaatagaacttttatcatatcatagatagatgagtgtcaatccatgataggaacccctatatacaatgtcttgcccactctagcattggattttattttcaaccactattagttcctctgatatataggatgttctcaacttgtaaaatcccgacaaggtccctgccactaattattctcttttaaaatcgaaactcttttgtcatgctaaaattttaggtcacttttattagtttatttttttaaaacacttatttaaaaataatttaattaattttggatgagaatttatgactcatttaaaaataatttcgcttttagaaccgaaacaccgttgtgccttcgactatggcgagcggtagtcgaagggactgtgagaggagattggcagaaatctagtgtggaagagcccactattgcaagattaatcctaggatttaaaatcatgctccaatatggaccacatgttaaagtgatccacgtagtattggccagaatttaaatgctagttaacataaaattcaaaattgtattggctaggaaatattttttaaaaccaaaaatgaaaaaggaatcaaacacaccttagtcttttaaatgtgttgatgcaagtggaaggaactcgaatcattcaaacatgtgatcttgatcttaaaaaaaaaagtattgtaataggccttcttttaataaacaaataaaataagaatattgtttcaatattaaaattaactataaaaagaaaccttgatttaatcaatttttaaacataacaatgtacttatacttatctacatttagtaaccgcaattttcaattttcaaacacattttgtgacggaatttgtggtcacaaacacttagcgactgaattagagacaaaatatacggtcgcaaacatttaacgacggaattttttttttcaggcgtgtttaaacacgcttaaattggatgtgtttaaacacgcccaatttggacatgtttgacagtcccatttttcaaaatattttccaaactacaccatttttcaaattatttattaaaaaagtattatttatttaaatttgtcgaatttcaatagtagagtttaaaatactttgtttggatggtaggggtgaacaagagacagatggggtcgggttaaattcaattttaaccttctgtttctaaattttgatcggatttagatcctaatccatttctagacttaaatgaacctaatgatctatgatttaaattaggataggatctatttaagacaagatcaagtttactcgaaacataagaatgtgagttctcattttctattaatgtaattgagatttcaagaataaactttatcttatttttatacacgatattataaattaaattatagttacttgtaaccataaaaaatagttttgacatcaatttggaaaatatagacaaaaaggagttaatatgttagtcttttttcagtgattaacacaacaaatgaaatgcactgtaaagatataataagggctattaaatttaagatctggcaaagaaaaaattgggatagcttgtgtttaaccctaacctatccctaatttctgaccaagtcaatattctaaatcctaacttgtctctaagcctaaatgaatctaatgatttaacgggttaaattaggatggattggaggatcttgcaccccccccctattgagtagaatatttatacaaaaaaagagggtggcgtgggtggataacgtaagtggaagaatgatgagacgttttatcagtctattagttactttcacacaatttacgagttgagaggagttagagttatcccatacctaaattaggaagtaattccataatttgcaacataaaatccactcttagcaatgtatgattttggacatctatagtacaagtcaacaattaacgtgagttccatgaaatgtatctcagttaccaaggtggaaaaattcaacatatcatttgtggattttgctggaatattaggtccttaattacttggcctaatacaattttgccaactgttagaaaattgatcactaggctatagctataaagttgtgtggagcaaacaatgaaggaaactaactgagtaatcaaattaacaggtaaaaatcaaaattctactcatcaacgatttctaaccaaatctttagtcatccacaaaaaattcaacctcccaaaccaccgacaaagcgcgatcaacatcataataatcagttaatcacccaacacgttcctatgtgcagtattattacaacaaataaatgacaattataatcacaggaatgaaaccagttttcataaatagacgtttgttcctgctaaccatatgatgcaaattaattaaaatgaacaaggtacctagactatatatatatatatcgtctaaattctctcaaacaggaagagtcggggaagcatccttaaacgggttaaatatgaggttttttgactgagggggcaatttttttttttaattaccctatgggacaaaaatttataaaattatcatttgggggtaagtgtaccacttatcacggcttctaaattagaaatcgtgttatgtgtcatgatctttgtttttcttcatttgaagtcgaagtcaaatttactacttcaatatacttgttattcaaaagtcgtaaatggatttataagtcataatacttaatttaatttttatttttgaattttaaaaagaaaatactttgaaaaattgtaaatatatttacaattttaaaatcgtagcagttacaactttttattcatttgtagtactatttacaactttattcattttttattcatttaaagttgtaaatactcttacaaaagcaaattaccattattgtgccaaatacttaattaacataattatatttgtaaaaattacttaacaagaacaaattaaatataacttatttcatatattaaaagtaaatattattatcaaaatatttaagtattttaaattttaaattttaaaaattacaaatatattatacaaaaataattaaataaatattcttaatacaaagtaattataacattaatttcagatatatttaataaaaagatatcaaaattaaatacaaaatattaaactaatttacaataattcaaaatgacttgcttttttaaataattaaattaaacaaatttttaattctttaaataaccaaaaactaaaatacaatataacaaattcaaataatacaaattataaaaaacaaataaaaccaatgagttacgtaacccatatatataacaataattttaaaaaataataaacaaaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacaactttcaaactaacttaaataagttaaatactttaaaaaataataaaattaataaaaatttaaaaaacacgtacagtcataaacgtttttactacttttgaattggcatttaaaaaaattgtttttttggcggaatcgaaaatgcataatgaaatcataaaattgactatgacttcaaaagaaaaaaaaagtaaaggtcatgacacatgacattgcacgacttatcccaaatgataattttataaatttttgagcccatgtggtaattaaaagaaattacccctatgtaaaaaaacctaaatatgattgaaacgtggtgttgagagaggcatggggatggaggggggaaaagtaaattgcttggccagaaatatcattttaataatgttcagcggaagtttaagtgttaaattttaaagacttagttataaacttttaacattataataatttaattaaaaatttaaatcatagaaaaacataattaatgaaattaaaagaatatatcaatttaagtaattataaatatattattttttaattaatttaataaatgactatttctcaatttattatctatttatattataaatctaatatatggctatacaaatgttatttttcttaaattttaatttcaataaatgttatatcttctaatactttcactaaatcttcttcctggtctctctttttactctttcaaaattcaaaataagaatgtgttttaaaaataaatccaattaataacctaaataatcttattatattattaggtaaaaaaatgttcattttcatcacaatgttaatattttaattggttgatttgtaatatgagaaatattgatattacattctctaacagtaaatttagtaggaaagaaagaaatatgttaaaactatgatggattgaaataagaaagagagaaatagagtaaatgaaaatagatgaaaaatagagtaaaaacataagtgtttgatttaaggaaaataagaaagaaataaaaaagaaaaaaattaaaaaattcattaataaacaatctttttaacaaataattgattattttatatgactgctgctttttgaaaaataattttatgcgtttttggtagtttttgaccaccaatacatttctatcactaaatgtatttttctagtaattttcaacttttgttaaaaaattatcacaaaatgttaaacattgacatttttactatttaattctgttcatttttgtgaagaaataaaaagatgcatgtgagactcgcacttttttttatttctctcactagttatttatcctctaataaacacactctattttttattttcctctatttcaactcctcctccttatttcttcttcatagcatccctaccaaatatatcttaacttttaaatattttattattattgattgaaatttattagaaataaacaaaaattatgctcttattattttacgtgtctaacttgtgattttctagtttctaaaagttttaactaatatataaacgagtgtgttgacgagaaggttaaaatataaaataaagagtgtgaaagttgataaagtgaaatatagattgagaaaggacatattagtaatctggtcatcatttattatttagcaatttattcttgagaaatatttttttagttacaacaatgcttaacttattaacagtttatggttttgagttaacttagtggtttcggcccagcatctcaacgaaaataacacaaacataactggataagactaatgggtctctcgatgggttcacaaggaaagagacaaaaagcccaaaaacaatggaaagcatgaaacaagactgacgcaataaaaagacaacaacaaattatacttcctgttcttattttcatcttacatcaaactctcctaattttgtatcatttattatactgtgactccctaatccccaaacaggataaaaaaataagtatgtagaaacaagaagcaaaaataagtacatatttataattattattttttaaaaccaaccaaatatgtgttgatctaccagtgagtcaccccttttatgtaaacttatagaataatgtatttaattatttattttagttgattaatttcatttattgttaatttagtgtttttagagttgatctcaaacccaaatcaaacaaaaaaggaaattaatttctgagctttatgttattagtcctataaaattcctcaaaaaatagtccttttattttatataaaaaaagcctgggcctataaaataacagtaaaaataaaatcaaacgaaataacataaaaatatcgaacaaaactaattgttgacacttggataacgtaaaagatagattttaataagtcaagatgacatttttttaactagaaggtatctggacttctattttttattgatgtaagaagcaagggaacaactaatagttgagatcgccagatgctaccttttttttaattacttccattattgtattttcagaaaaagcataaattgaactctatgaacagaaaccaaaaagaatgtagcgcggcaagcatttaagctgaatttcgtccaatagattttagccatgatgcaacatgagtttttgtccctacgcaacaaaatatgaataaactaaagcatatcctttgcttaatctttgagcattaaggcaccgaaagtggaggaaaaatacccttaattagagttattattatttagagtgaaacagaaatgagtgaaataatcggtgggtacccttgttttagactgcggcatatcgtttttgtgcccctagttccacaaattaaactcgtttcgttccgcgtttcacccttgaatttgcccacgcttttctcccaagactaagggacctttttgataattagaatgaagacttcccacaaagttcaacttcaaatatgcgttggccaaccgtttttgacgaagcccactgactcaaaaatcagaatgtaacctcgccttcaatagtcctaattctcccaacaaacaaataatctttgtgatcatttgactgtttaagcaacacagtgcctattacatgacaatttctctgattaattaatacttttagtgcatatagtactatatatagtactattttcttttaatattatatccatgcaactgtaatgttatttatattcaaggaaggaggatctttaaccatagacataagcacaactaattaaaaacttgaatttgaccggttgatcttagacgtctcttgtaacactattacaaaaagaccttttaaagatggttttttttttttaaatattgttcagattacaccataactccataaggttgtatctaacgaacagcaagcaaggacaaaagactcaaaattgaaatggcagaaaatgaattatattgataaacacattcacaaactatttgctaaactatacctaacacattgcagttttagaacctggagactaactaaataggtgaagaattaatgcatagctcatatagagtaattattttactatttcaaataagtgaaagttataaattattttgagaacaattagatgagtaaataatcagatacctgcattttagcctcttcccatgttaatccaaaccctttaccaaaaatctgaccatctatttcaacctcaaacatgagaaaattgtttaagaactttcaaaacttgtttaaaaattctcatgaaagaaattgaaaagccatacaagctttaattgtcaaatgaaaaagaattgaagaagcacttctgaccttatctaatttgattattccacaactttttttgttacactcacttattcattgcattttgttacactcattcattgcatgcactctatttggctatttcattgtttagttttcattcttctagagtagaggcttcacaaattcagatataactaattattttgttttatgagacttggttaaagacttccaatctaggatctgaaaatcctagatgactcagatgcagttaaaaatgagactgactcttctttaggcaataactgattaccaatagtattacaactactcgcaaaaccattgttgtttgaaccccaccaacatcatcgttagtgaaaccagaatcatccttagcatgagacatatatatatacacacacacacacataatcattataaaaagggtaaaataaaatgccacatcaagtcataattaacaaatttcgaaaagcttaccagccaattgtttgatttaacattcaacaaccttattttgggcttcccttctagttttaattaccaattccttcaccaacttttttccagcaaaccatggttatgtataagaataacatcaagttgaagcatattaataaattttcaaaaaatataatgtaggacatatttttgtaaatgacaccactgtataggaagcaacacataaccaaatttgagcctatgattaaagcaattatgaaattaatttcatataaaaacagtaaagccaacaatttcaaatctactcattgagatatagcacaccacacacccaatcccgtgtttagtaaatgtaagttatataactaataaaaaatttatcactatgttggttaaaataagtttcttacaataaattaagtatagaaaaaatagcacaaggcaaattcattgattttataagtaattttaccctaaattaatagaaaattagaaatcaaaccatatcatagataacccttatgtccattacacataaggaatccccacctatttcctagtatccctcaaccatttaggttctctcccttgaaaacattgtgttggatataccttaaatcgcgtcgttgttgtcgccgacgttgtgtggtggcatggcatcaaatttggttctgccaaggagaaaaggctttcgaagctcgtcatcgcccctgttgtaaagaagttgcacgtcttcgcctggttgagcagagggagagggagagagcgcgagagtaacaggagagggagagtgaaagagcgcaagagtagagggagagggagaaaaataaaattaaaaacattaaatgtcttgatataaatattgtatcatgcataatagaaatcaattctaagacgattttgttaaaattgttgtgaaatgactaatattctaagaaagtttttgtaaaaccataatgaaatgatagtttctaagatagttattgaaaaacagtcatgaaattgtttttttttttatttacaaaaatgttatcatattattttccacgatggtcatttatgctcaaccgatgttaaattaacgtcataaaaacacatttttatagtagtgtaacatgcaaaatacaaacatatatttaaagtataatttacttatttctttttaattccccttgcgatacacctaatacacctaaaatttaatattactaaaagaataatttatccatctttaattataagaccttttttaaaaatttatttgtccaattttataagattattttctaatttttaggtgcattaattattttttttacatactcttacttaattattctctctaaaaaaattaatgaaaaataattaaataaatagatagatagataaaaaaagaataattttaaaataataatacaaataatttataaatttaatgtgattaattaaattaactatttttataatgatagtaaattaattgaaagagtcttataattaataattgagtaatatatgaatcttagcattctagaacaaacattttcctattggcatgtgtgccaaataaaagaacccattattcaactttataaagacctcataaatatataccaacaaaccaacatggggaagcaaatggaaagcgtgtgacataaaacgtggtcggcaagcattcgaattcaaaatccacgactgaaaagtaaattaaacaacggtcacaaagaaattaaaccacttctcgctcataaaataacaaaccgctatcattgctatataaacctcaatcaaccaacacaagtttcataccaaaccaaaattcatcaatcaaaacacatcaaattccactcactactactctctctttccattattgtccccttaaaaattactctctttctctatccttaattataagatcgttttcagaaaacatgagtgtagaaatactagacggtgcaaccatcgtagggttcgtggaggacgaggaagccttcaacgtgtgcgtaagcgacctcttcacccaactggacaccgacaaggacggtcttctctcttacgcggagatgctgaaggagttgcagaggctgagggtgttcgagacccacttcggcgtcgacgtgaagcgtgaccccgacgaactcgcacgtgtgtacgagtccatgttcgtgcaattcgaccacgacttgaatgggagggttgaccttcaagaattcaaggaggaaacgaagcagataatgcttgccatggctaatggacttggatctctccctgttcagatggctctcgaacacgatagcctcctcatgaaagccgttcaaagagagtactgtcccaaaattgccgcttaaagaattaatatgcatatggggaaattttgcatccaccgcgcgcaatatatgcatgcatgcatggtggtgatatatatgattcatcatttataagctttcttacgttttaattttgtgtcattaattcagtggtttatatgtttgtgttttgattaacttttattgtagttgttggctagttgggtacttgcgcttgttgattgcttaactgttcattgatcaattagaaatgagaaattaaaaatcgtatggaataatttttgctggttctttttgtttttgtgtcagagtttaaaccatgttgcccatgctcatgtacgtatgcgagaattaaacagagaaggagcttaattaattatctatcgtgtcttctatcagttgaaaattacttctgaagtgaagatgaagatattagattgattcaaatgattagaaaaaaatgaaactagaaggaaggaaagaaaaaccgtgacttccaattcctccaactaagatttctaaaatcaacctatcattttctcttttgtctttcaactcacaccgcaccaccctcttttttttaataagcaccgcacccccgtcttctataaaaaaaacatgaatgcacgagaattaaacagaaaaggaacgtaattatatgtcttagcttctatcaattgagagtcacttctcaagctatcattttcttttgtctttcaacccacaccgcaccaccatctcctataaaacattaaattttagatagaaaatgatttttttctatcaatgaatgttagtgtttagtttattattttatgttagtgggagaaattcaaacttataacctctttatctccccttttctctttaatcaataaattgacctgataactccaacattcaaggaaatttcatgtttttttaaattaaataaatatataagatcttatccaacacttacgattgatttttaagctacatatttgtctcaattattttagtgtaaaagtgaataaaagttataataaaaaataagagctttaaaaataaaataaatagttcaatcatttttatttcttttaacttaaaggaaatatttcgtcttgtccatattataagatatagttttagaagaaattgatggtcctttttataagaaattttagaatttttatgaagcatttaatctcttttcatagttgtccttattaaatatttttaagtatttatgttttttattgatagttgtacataatattcttgaactttaatattttcacgatcacatacctataataagttaatgattattaataagaacataattagtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttttttttttaaaaaaaaaagaaatttacatcaattaaaattaagcaaaatatctcatagaaaacaaaattgaaataacaccaatttaccgagactaaaattaaaaaaaaaattacatagagcaaaaataaaaataaaagtattcaaatttacatatactaaaaacatatttaaaacataaataaataaccaaagagataagaaaagaaattaacaagatattcttctaagaatggatcttcacctacctcttttattgcaaggtttatcgtcctttcatctccaactaaaactaaaaccgttgattacattatttctggattttgggtacatttttttttggtggaagagaggggattttggttacatggtaacttggttaaatagaggatctaaatttcttcttctttttaactaaagttgcttcactcaatttgttttttatcaactaaatttgtttaaaattttactttttcttatcatttttatattatttgagagttttaaaaaatatatttcaccaaattctttctaacaataaaaattaaattacagtaacaccccctcagctaattattctaattaaatatgcattatattacactggtacctcatgatcctttaacaccgtcaattttgttaactccaacagatcaagatcaagtgccagcacatgtattttaatgatttttttttttttttgctaaaatacccctctcttctttttgggtatctgagtttgaagaaaaaaataattgcagcaaagagcaacttcaaatcgaggaagaactccaaacaccatccaaaaattttactttgaatctcatattaggagttctttactttgtgattttttttaataatagttagaagtaacgtgttaatatcatgaataaaaaatgtttcaacctgttggaaaacttgcagcagcataaatttctttcaccaatattagtcaaataaaaacaaaagaacccatttgagtatgttgaatttaacgtatctcaaaaaccaactaaattgtaattgttgagatctctgtgaatattttagtggaccgctaagaagaagaaaaagaaaaggtgcactgataaaactaatgtctcgatgaaacaaagatcaagaaaatcatcatcaagcactagcagtggggaatcaaatattcggagcaaagcttttgagaagatcgaattggtgattgatgttgcgtcggagtttgggcatcgtgaatcactctaactgttgacagtggaagcggcaataccctgcagagcttgaacgcaatgacaaccaagaatggcaattttggattttcggaaaggttattctcgtaaatgctttgaaagttaacgttggattaacaccatcagacagaaggagtgtcaaaataatgccttcaaatagaggaaatatatgtgtaattaaatcaaatcttagacaatgtcagtgtaatttactaaaaacaatcctagcaaaagttaaaacaaacctagcctataattatgtaacaaaaacaaattagccttacataacaaacatcattgtcttctacccaattttttttataattaagaacattccatttaactactactaggaattgctgttctctgcaaaaagattcacacatattttaatgagagtcaatcagtccacgcgcgttcttcggtttcacctttctactttccagtcaaccaagcacaatatttaacgctaacgtcaacctaattccccatcacaagtgcaaaatggaagaaggatttcaaactgaaaatatagaaatcagctagtttccatggcatggtacgcataacatctactttgagtcaacaaaaataatacaaaaaaaaaaatcatgtatggtcagtgtaaagatgtttacactatcaatttataaataattatattaaatatcttttaaagataattattataaaaaataattaataaaattattatacattattaatttggacttgtacttaaaacattattaaattaattcttatatatatatatatatatatatacaattgttacatgtttagttccagtcatcttctcagaatggtcttaggtggagttttatcattgaccttgagttatttttccccctccaaccctaaataacttacatttcatttcaaataaagttgtgcaatccaaatcaaaccaaatctacaaaaatcagaccatttaaaatgatttttaacccaacctatttattgtttgaatttggatttggtgtgtcatttattttaatcggttttgcaacatcacattccaagcaccattgtgaacaaaactccttcattccctcaatcttgcccaaacacgtaaaccaaacatgtgtctccctctcttactacacaaatacataagaagagatcaagttattttaagagtaactctaaattcttatcctttatttttttttataatctaatgattttagtaaataacgcacttttaatcgtaagattagattataaaaaaatcaaatgaaggacaagtataagaaacacaatgtcacttttggttaagaagccatgaacaataacgacagcaaattttaggggtatgaatagtacgaataagataacattgtttggccgacgataaaaaaatgtcttctccttttgttaccttttatcggtctcgttgtctaatcattgttatttcaggttttttcatctcaaacatcgacagtggtccaaattcaacacctactgtcactaccattgtctttaacaactcctctgatataaagcagtagcatatagagcaaattgaggagaagaagacaccactaaatgatttgtgcttctattttagtaggcctggattgacaaggacgagatccagctattgtgagggttcctcgactacacctcatagcaaggattctttcaccataatgccactgttttattatacaaccaaccaattattgaagctccaactccatttcaataacaactaactagcttgaaaatgttgatatttgttgaacccatattgcataaaaagatttatgaagttttgatgataacaaacaatgaatgttacattattagatttattacactgatgataattatttgatatttgaagttactgatattttggatttgatattttgaagttattgatattttggatttataaatatcaacataattgataagattatttgaagaatcctaaagattgatatcattcaagatgacatggaattaagaagatttatttttatttattttctagattttatgtaaggagattagaagattgatcttaccaaaatattatctttaagatttcattcaaaaataggataaaatattttttaacttgcattcaaaaataggataaaatatttttaagattgcattgcataatataatagaatatctataagattgcattgcatgataagataaaatatctttaagattgcataagatcttttaggattgcattcaaaaattcgttaaaatcatatacttaaattagtataaatagaaacatatgttattgtttagagtatgcattccatttcaaataatattagagttttagagagtttatgtttgcatcattaagagagttgttgtgagatcatatagaagcgtttgacaagtttgattcttcaactctccatcaggatttaaaggtacctatttgcttaaggaatagaagcgtaaaggtaaccattttattgtattcttcttcttgactttggaagaggtcgcaactgggaaactagcgtactagttctatctctattcttggtgaattgagacatgcgacttttagctgagaaactaagatactagtctggctaggaaacaaggatatcagtctgtctctatttttggtgaattgagacaagagctttttgctgggaaacaaggataccagttgggataatagttgtgtaaggatagactaggaaactaggatactaggaactcttgtacacacaattgtcatagtggagttgtccattggattgattatccaatttggatatcgtggtttttacccaattgggttttccacgttaaaattgattgtgtcttttttatctcttatttccatattattactttgagtttgattttaaattgtgaattattttataaaactcaattcacacctcctctcttgagttcatttgggaccaacaattggtatcagagctgggttctctttattttgcaggtaactcctgaagagtagatcttaagatgaatctaatggaaacaataagataagactactctatccaaagacctccactattcgagggaaagtactacaattactggaagaacagaatcaagattttcattcaagcagagaactatcaattctggaaggtaattaaaaaaggagactttcagatcacaaagatgaatgaaaagagagaaagagtgccaaaacttgaggacgaatatactgatgaatattggaagaagttggaatacaatgcttaagtcaagagaattcttcactgtggactagggacacaataatacaattgtgtgatgggttgcaagactgtcaagcaaatgtagaatcttctagaggtaacacatgagggtacaaacgaggtaaaacagtctaaaattgatcttcttatgcatcaatatgaattgttctctatgaagcctaaagagtctattaaggatatgataacttgttttactaacatagtaaatgagttacatgctttaagcagggacatacaggttgaggagcaagtaagaaaaattctgaggagtctccctagagagaattggatgtcaaaggtcactgctttgcaagaaaccaaagattttaagactttcaaccttgagcaattggcaggattgctaatgacatatgagatgcaactagagtcccacagaaaggaagatgtaagattaaaggataaaagcattgctttaaaagctcaatcaaaggaagtgggtgatgactcagatgatgaggaggatattgaaatgcttgtgcagaagttcaaaaaacacttaaagaaccaaaagtttaatggatcgaagctcaagcaataaacaggtaaaatccaaaaccttctcttcttcaagaactgattatagttgctttaggtatggaaaaacagatcataggattaaggattgtcttgaagtagagcaagaaagtagaaaggagaagaaggctaaagagcagaagaagtatgataagaaggagttcaagaaagcaatgatggctgcttggagtgattctgattcagaggaagaaggatctgaaagcagtgaagctgaggctaacatctgtcttatggctggaactaactcagaaggtgaagacactaaggtaaattttcttgagctgatatcttccatgcatttgttaacaaagaagcatctattgaaaatgtcagactttataatagatgagtatttagaaatacgtgaacataatgatgaattgattgatgactttgatgaattaaagaatgagcttaaaaaattctctaaggctaataaagaattgagaaaaaccaacgagagcctagaggaggaaatcactagccttaaaaatatcgcttctgaacttgaaaacgaaaatgcttctctagttgttaaattgaaagagcataagaaagaggaatgtgtggcaatttgtgatgctctattggaagaaaaaattgaaaaattggaggatgaggtagaaaagttaactaaagagaataaggacctctaaaataagctagagtttgcccttaggactcccaaagtaaatagacctgatgctattgactgattgaataagaattgtaacacatttatgcacgggttaggctttaaatagaataagaaatctatctggaaaacaaaaactacgcatatggacttgtatgagaaaatggtgtgttatcattgtgacaaggtaggacatcttaaatttaaatgcaagagtaagataaaagttattgaaaagaatgttacataaataaaattctgaagtatttcaaaaagttttaattgaagtatttcaaaaagttttaattttttaatcaattatgtgattaatttcatccctcttcaaaaatatattatatataaattattaaaatctattttttttttaaatttaatatatgttatcaattgagttctatatatatatatatatatatatatatatatatattatgggaaatgggaagacttgactctcgagacgcgttttaataatgcatataggaatgcgacaaattagactaacattcaagttgtaactatcagttattctcgaaattactcggcaattttatttggacaaccaatagtgttcctttttgaacttttttatgtattgaaaataactttttttgttgttgtacatattacgtgtatccttctgaggcctacttgaggctgaattacagtaggtaataaacttatctctcactatcaacagtatatatattgaatactatcatctatctctttctctttttcaagtgcctagtaagatgggcgcgtcaattcaccattttcctatataatcactagcgtagtagcgttgcccacacaaacaacatactttatcacccgcgaatctagctagcttttacaactccaacaacataaagtagccttctgcttcagattatcaaatatgaaggtgatatcacttgcaatgattaataaatagttaaattacaaggtatgatatttatttgaataactcgatctatgtatatatttaaattaatactgccatgcatgaagcagaaaatagttataaaggtgcacatggagagtgacaaatgcagaagcaaggctctcaaaattgccgctgtatgtcaaggtgcatatgtcatgttcaataatttccattcgatcatccgttgctaactttataagatccattttaaatttgattgatataaccccgacaagtctaaatacatagctagtacctagtgtataaatcttgattcatatttcatagagtaagtatatatgcagccattttatgtgaacaacgttgtgcttcttctttgtcatggccacatatacaacaaattaaaaccttgccgacaaaatttgtcaatattgacaatttttgttactaaaattttagcgacaaattttttaaaattacatataaattattttgtcactattgttaaatttattttatatatatatatatatatatatatatatatatatatatcaaacattcaggtgttcgatcattagcattagaaggcgaaaccagtgatcaattggtggtaactggagtaggaatcgatgctgttttcttaaccaaccagatgagaaagaaattctgttatgcaacgttattaagtgtggaagatgtgaaagaagaagaagaagatgaaggtggccaagatggaggagaagaggaagatgaaaccacgacagaggaaaactatcctccaccttgtcccatatgtggcacctatcattctcctatgtaccatcacgtagcatatgatccataccctaatagctgctccatcctctgagttaattaattacctctcctggttttcttcttgtgattgtatggaaaaggcttttgacctttccatcaaaaggataggaaaaaaccatatattaaaaagcgttatgctttgcttaggaggatatggaataatgataaggttcaaaagtttctttagatttggaagtgcatgtatgtaaaaagatattttgttatgtgactgaagctagctagtttcatttgctagaaaatctattaacctaaatttcaaagtatatatatttaacatgggagtttatgaagactgagtaaattcacgatttaggttttctgccaaaattttatgtacaatatacatatacacaaacccttttaataggctatggtgatcacaaattgatgcatccaacatctatcaattggatttttccccattaagaatacaacttttttattccatcgatcttaagcggaaaactctactcttgaaattagtcttccagcaaccagccaatttcttttaattttaagtaattaccataattgtcttaaaaatattgacgttgttttcgggccttcaacgctaagactaaacattagtcctccctcgaagctatttttaaatcatgttgagaatggtcaagtacgaaaatattcagcagcgttatttgatacgaaaatattgtatgaaaatatgagtttttgttagtttgactaattaatttaacaagattttatgttaacttcattaggtgtatgagcactcaattttgtctaatatgtaaaaaattgaatatatatatatatatatatatatatatatatatatatataattattgtatgatgttggatatataatatagttaaattcagtttgaattaaactaatttgtaacataagaatcgaatcaatgaagtttagtttaattgattgattaaatgaatttttacaaatttcatagtatttatcatttaatttctgtcaagaatcaaacttgttattattcaaataattcaaccctaaatttaatatattaattacttatactaatcacttgattatattaaatatatttgaatagttggtaaacacctccaatagcatcgtattccaccttctcacagcaaaatcaagaaaagcaagtcatcgtttgtcattataatgtcctagacagcaatcttcttccgtcaaagaaaattcttaaggaaaaattaaacaacccttcatttgtctgtgtcctgtatcgatcgatcttaatgttcttccttcctactttcatagaaatttcctcaatttcttagaactctggccaatacaaataatatcacaaacttgtgtgcttatgacacaagtgaaaaaatacaaataattatcagacgaaaatcataagtatttatagtttaaaaatactaaaaagtaatattatttttaaaatgttggtaaaaaaaatctatttttaaaaaagaaaacttttactcagccgccgtttctgaccagcccgtagctagacgttgagtggatttgcgaacgatacctacatagaccaataaaactaattttaacattgccatgccaaaaaaaaaaaaaaaaatcaaagagaaagatgtaaatgtttatttttttatgtatgaaataaaggtctcaaaacagttcaattaattaactatttccaaaatgcatggaccaattgccctctttacactgaggtatctcaattaatagtgatgtgtgtggctatgtgtggagcttaaggcctgagattgtgatgcgctgatgtgtgttttttttatggattataagtatgttttatcgtaaataatcttatttaagttagataaaattattataaataataatattttcaataaaagtgtctaggacttatttgtgctagagaaaatatttttttaaactgatatatttcatgatcataaatattattaattaaataataaaatactggcaattagtgtaagaatagcttctaaaaagataatttgatgtagagtaatctagtctattcaaaaaatcaaaatatatattacaagttattcctccaacacgggtcactccccctccaatatattttccactcaaaatttggaagacatgtttctgtccaacacatgtttttggaagacgtttacttccgttgacaagaatagactaaggtagaagactttcaataattatttctaatatatcacatacaattataatatttattataatattctgcttacagaaatgttatttaatataatatactttacaagatatattattatgatattataaattatatatatatatatatataatattcataatttattatattatcataacattatattatttaatattttaataaatatttttgtgtgtaaaaattatatatttttattttgaaatctcatgagtaaattatttattatatatatgtatattcattcaatcagattcttccactcactttccccctcttccttcctatccccctttctttctacccaatcaaactgagggtaaggattttaatttttaattttttttcaaaattttcaataaacacttataagacaaaaaatgaaaaataaaacaaacttatattttaaactaaaattaatttatatacaagttaaaaatcaacttttaaaaaagataatataaaaaaatttctacaaactaatttatggatacataagctaattttaatttataattttatttcattctttttcttattttattctcttctctatgagatttaaatttagaccggtctattacgttctccccccctccttggttgttttacaatatcacattaaaggttgaaattttacaggattttgacttaacttggttgaagaggatctaaattccctttttttcccttaaaagttgcttcacccaatatgtattagaaggctactttttcattttctttaataaaattaaactacttaattttaaaagtttttccaaaaaatgtttgacaaacttctttctaaaaaaaataaagcatatataattaaaattaagttgaaacaaatctagccacaatagattaaaaaactatgtatttattgttgaaaaattatttctaaatttgaattcatgactaacaagtcattaaaagttatgcataaataagagttcacatttgatttgaatatactcttaagaaaatcaaatcgaatttaaaatagaacttcaaacacgaggccaagtctttcaaagagagtccacgttcttcgtaatttttttaccttcaaacacggggccaagtctctccagtcatttggttctttacctttaaatactctcttcactttccaacaaaacacaatattttatcgttaaacgtcacccaatttcccatcacaagtgtaaaatggaaaaaggactcaaactgaaaaatagagaaatcaatcagtttccatggcgtcctgcgcaatatgtctactctaagtcagcaaaaataatgcagaaaaaatattgataagagtttaattttccatcgtgcgagtattatcaattaataaaaaattatattaaatatgacttttcaaataattattataaaacaaaattatcatatattaacaaaatataattgaataataatgtaaattttttatattatcagtgtatttaaattaagttgtactttaatatgtatttttatgactttttatgattttgttgtcgtagagaatttacaggaaacctgtcaaataaggtgggttctgttctctagttctagaagatcccattacttataaaatgaaatttaatagttttaagcaaattataaaaagtacgatagaaaagtattactaattaatatttttatgcaaaaatcactgttacatgcggatgtataaacggtctcctaattgcaccactaccacgaaaaaccagaacatcactagctaaagcttctccccaaacataaagctaaagctgtcctctgttttaaattaccaaacatgaaggtgagaccacttgcatttgttagtaattaaattattgcatagattcaatttgattcaataataaactcttcacttctgcagaaaatagctatccaggtgcacatggagaatgacaaatggcactgaaaatggctgcagcctctcaagttacaattatccgtttattattgagaaatgttacttatacaataatttatacaattgacagaaaaaattgattttaagatgaataatgtgatggacaaagacataaaaatgactttctacaaatttttgtatgagcatcatgttagttataattctgtttcttttgaagtaccttttaagtccttgagttagttgtatataaacgtagcctttgcatcaatgaatatacagaagttctattcttactattttctctctatctcttatgtgtgaattttcttaaagaaacagtgaatgtgtgagtgtgtttaaaggaaaacaccaagtgcaacagagcaatatcagtttaacagtggtatcttgagcttaggttcgatcaagaagggatcttgctactgtaatcatggcgtccaatggtcatttttcggcaaatcttcctattctcacagggaagaactatagcagatggcatgttcagatgaaagctgtgtttggcttccaagagttgttggagatagttgaaaaaggcattgaagaagaaacccctgatgcaaagacgggaaacaaggatttaaagaagaaagattgcaaagccttggtaattcttcatcaatgtgtggatgattctcactttgagaaaatcgcaggagcaagttctgcaaaacaagcttgggacatactgaacaaaacatatgctggatcagaaaaggtcaagaaggtacgattgcaaacacttcgaaggcaatttgagatgctgcaaatggaggagaatgaaaggataggagactacctcaacagaatgcaggttcttgcaaattccatgaaaagttgtggtgagaaaatcactgatttgatgctagttgaaaaaatcctcagaaccttgattccaaaattcgatcacatagtggttgcaattgaagaatcaaaggatcttgagaccatgtcagtagatgaattgcaaagttctcttgaagtccatgaacaaagacttcaagaaagggttgctgacaaaacttctgaacaagcttttcaagttcagaacaattcaagaaatggttcaacagatagcaatagaggcaagagaggtagaggaaaattcaagttttcaagaggaagaggtggaaactactcgaaagaagggtgtaaatctcaatctgatcaaaagaatggtggttcaactaaaaatagaggaggtttctctggatcaaaaggtagaggaggcaagaaaatctgggacaagaagaacattgactgttactgctgtggtaagaagggacattactcaactgagtgttggtatagagaaaaggaccaagatgatgaggctcagcttgcagcagagggagactcagatactgaaccagttttgctgatggttacaacaaaatccagtggagagaatgatgatcactggtaccttgacacagggtgttctactcatatgacaggacacaaagactggtttatcagtcttgatgaatcaatgaagaacaaagtgaggtttgctgatggaagtactctatccactggagaagttggcagtgtgatgattaaaataagggatggcaaagaatcctgcatagaagaagtgctctatgttcctggtttactaagtcttggtcagcttgcacaaaagggctaccaaatgactatgttagacaaaaggatgaaagtttatgacaaacagaaaagactaatattgaagcctcctctatccagaaacaggactttcaaagtaggcatcaatgtgctggaaagcaactgcttactcacaaccacaagcaaaactgaatggttatggcattacagacttggtcacctgaatttcaaggatataagtcatatgcatgagatggtgagaggaattcctcaactgaaatcaactactgaaaaatgcaaggattgcttagaaggcaagcaaacaagaagacctttcaaaagctttgttcctgtaaagtcaaagcagaaattggagattatctactctgatgtgtgtgggccaatacaaacagaatcacttggtggaagtaggtatttcataacctttgttgatgatttgagtagaaaaacatggatttacatgattaaaagaaaaaaatgaagtgtttagtattttcaagaagtataaggctgttgttgaaaaacaatgtggaaatcatattaaaaccttgagagctgatggaggtggagaatacacctcaagggaatttgctgagttttgtgaagaagcaggtataacacatgagttcacacctccctacactcctcagcataatggtgctgctgagagaagaaacaaaaccataatgaatatgatcaggtgcatgctgaaattcaaaaatctgccacacacactataaagtgaagctgcctctacagcagtttatatacttaacaggtgccctaccagcaggttgaagagtaaaacaccagaagaagcttggtctaacaccaaacctgacataaaccatctcagaatttttggttctccgtgctatagacatgtacctgatcaactcaggcagaaattggatgacaggttgagtagatggtttttcttggatatcgctccactggaggctacatgctttatgatccaagaaacaatcaagttgttataagcatggatgttgtttttgatgaattaaaagattatgaatggagagaagattcagcaaacaaaactgttaaaattcaaatcactgctggtacctccagtgatatgagtagtgaagaggatgctgctgagatccctacagatggaagtgatactagaaaatctcagagaatcaagcaaactccatagatattgaaagactttgaaatatactatgaccagcaaataactgaagaaggtgagcttgtgcatcttgcactgtatactggaactgaacctgtcagttgtgaagaagcctttctaaatactaaatgggttactacaatggaggaagaattaaattccattgagaagaatggaacctgggagcttgtgacattgcctaaggagaagaggccaattgctgtaaaatgggtgtacaaacttaaaaggaatccaagtggtgaagtgatcaagcacaaagctagacttgtggctaaagggttcttgcagaaagagggtattgactatggagagatctttgctcctgttgcaaggattgaaatagtaagggttgtagctgccattgcctgtttgaaaggctggtccatgtaccaacttgatgtaaaatcagctttcttaaatggacctcttgaagaagaagtctatgttgatcaaccaccaggattcaaggttactggtcatgaatctaaggttttcaaattgaggaaggccttgtatagattgaaacaagctccttgagcttggaatatgaagattgacagtgttttgattgggattggttttgtcaagtgcccctcagaacatggaatttatgtgaagcacaattctgcagatgagctaacaattttttgcctctatgctgatgacttactcttgactggaagtaaggcaaaagagatagaagttgtgaagaaattgctaatgcatgagttcgaaatgacagacttgggatctttgtcatactttcttggcatagagttcaagaaaactgaatctggtatcattatgcatcaatcaaagtatgctggagatattctgaagaagttcaagatggaagaatgtaatgcagcagccactccaacagaagcaggattggctttgagtctgaaagatgtgggagaattggttgatgctacagtttttaggcaaatggttggctcattaagatacttgtgcaatacaagacctgatttggcttacagtgttgggattattagcagattcatgaaggctcctaagacacctcatttgatggctgctaaaagaatactaagatacataaaaggcacaattcatcttggagttttgtttccttttggccaaggcaactctgaaactgagttagtaggttatactgactcaaattggaggggagacaatgatgacagaaagagtacaactgcatatcttttcaagtatggagaggcaccaatctcttggtgctcaaggaaggaggatcctgtagctctatcaacttgtgaagctgagtatatagcagcttctatgggagcttgtcaaggaatgtggttgagaaaattgctaaaggaaatgaagatactaaagaggagacctgtaacactgcaaattgacaacaaatctgcaataaatttggctaagaatcctgttgatcatgggaatagcaaacatatagaaaccatatatcattttatcagagacaaagtgagcaaaggcaagatcaaattgacgtactgcagatcagaagataatcttgcagatttgatgactaagcctcttagaaaggttaaatttgaagaactcagagacaagctgatgtgcaaagctgaatagaaatcagaattatggggggatgttagttataattctgtttcttttgaagtaccttttaagtccctgagttagttatatataaacgtagcctttgcatcaatgaatatatagaagttctattcttactcttttctctctatctcttatgtgtgaattctcttaaagaaacagtgaatgtgtgagtgtgtttaaaggaaaacaccaagtgcagcagagcaatatcggtttaacacatcatatttcttagtgcatgtttagattaaagtttgcaatattaagtttaagtgagacttaagtttgcaaactgattttacaaaaactgaattttcagacaatgtgtaatcatattttttgagggtaactaaacatatcaccaaaatgaaattacttttcaaattgaatatggaggagatgaagaacaagaagaagcagaaacagaaacagaagaagtcacgccaaagcaacctcattatgataattaccatattccgaattgtccaatatataccaatagtatgttccaccttctccaacgtgtaccacctatctttagggatggcaaaacgggcctggccagacgggccggcccgtttagcccacaaaaaaatgtgggttgggttgagattttgagcccacattcattaaacgggccgggccaacctggcccacaaaaatgtgggccaaatgtgggccaggggtgggccagcccaccgggccagtagcccaccaataaaaaaataaaaaaaatatttaataggtaattaaatgagtggtttagaggaagagtgactaagaagaagtgagtgattttgaatccttaagcctaatatatttttatttggaacctaataataagttatactacatgtacaaatatgttttgattgcctacatcattgtgaagcaaatttctaagaatttgttaagacttaggagctaattgaaaatcattgttagataagtattccctgattatttttgcttctattaggcatgtattttatattaaaaattattgttatatgattaagttagtacattattaatttttagtataaataattacatttaaatttttttaataatttttttgtcttttttctaaaaaaatatattttattttatttttaagtgggttgtcccgctggcccactaacccactttaaagtaggatgggttagcattttcagcccattttgtaaaagtggatcagtccggcccgacccacttttttagtgggttgggccagcccggcccattttttggtgggctggcccactttgccatccctacctatcttccaccttgtccaatatgtgccactgccacatattttccaccttctgctcccatgtatcgtcccacagtttatgattcataccccaatagctgcatcatcctttgactctattgaaaaagcttttgacatatttccatatcagaaggattccataaaaccatttaggttggatatgctgctgagatagtgttgttggacttgataaaatttagattttggtactagttaacaggaaaagttaagggtttttttttctttttcttttttaaacagtctatatatatagatcctttgttatgaatgaaagctctgtaagaattgttacacttttataggggttgaggtactcttgtacctcatcataaatatattttatctttgctgatgaaaaatcattcacgaatcaaaagcgttacactaggctaattaggatatggttcaaatttctttagatttggaagtgtatatgtaaaataacacatttgtaatgtgactactgaagctagtttatttgctagagaatctagtaatctataaatttcaaaaactatatatagagagagaacaaggaagtctgtttatgaagactgcagagtaaaggtttgattttctgtcagagaatgtataatgcatacaaacaaacccttcaatatattgaggcggtcacaactaaatgcattcaacatctatcaattaattgatattttttcccgttaaaaatacaactgttattattttccattaactatactcattttttgggtgtcttgaaaactctattcttgaaattattagttagtctttccggaaataaagaaattattaccattatatatatatatatatatatatatatatattgaggttgttttcaggtcttcaagccttaccctaagactaattaaacaccagtccctccccccaaagcaaccttaatttaaatcatgtttagaatggttaaattgttagaattaattacgcttggtagctgtcacacacaatgaaaaaaacgcgtttccatgtgcacatcctactcttatgaaacttgaagtataatatgcttatttagtagtattatatatgtagtttaatgtcttggttgcaaattattatccttattagggattacgtgtaatcacagcggatacattttttgtagtcactaccgtttagttagtaaattaaactcggcatgtaaacaaccaataacaacacttcttgtctgagatagtatctttattcaataatatttttctttaaaaaaatggtacgaaaatattcttgtacttagaaaatagaactttcggcaatatcagaatatgattatggacggaaaataaatacatttcattcacattgtatagtacttatgacgcaaatgaaaagataaaaattattatcaaatgaaaagcataagtatttataattaaaaaatatttcttatttttttaaatggtaataaatatagttttacatgagtttcaagaaatacgttaatgattttatttgtataaaaaaaatactcaactaccgtaactgaacaacccgtagctagaccaataaaattaattttaacattgctatcctgcaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaactaatcaaagacaaagatgtaaatgtttcagaacagttcaattaattaattatttaaaaaacgacgtttaccaattgctttgctctttttcccctcaggtatcccattccttttgtagtcatgacctcgacaaccacttgacttactacaacctagctagtggtacgcacacatgtgtttgttagagagaaagagagttttaattctgagatagtacgtatttcatatatataattctgagatagtattaatactgtactcgatatatcgatcgttattgatgttaatttatgcatcattaaaataacacttaaatataaatatattataattttttacatatgaaatctatcgatataattcatgacaatgatatatttagaagttgatgtagatattaattgtgcatatagatatctgttgtttgtttttagtttgcaattataacaatataatagtgaattataaaaaaaattatatggacaaaataatcatgtttattgttaccaaaattataattaacattactgattcacaagtcatttcataataacaatcgaaaagctagccataataaagaaaataggaagtatttggaatatatagaatcaaataatgtttccagttcaatagacatattctaataaaagtgtatgctatttcaagcaatcaaacacaactaaataggtcaattatataattacaaatatttttttagacaaaataacattattatctagttaccaaaaggtaataatacttaagggtgtgcattaaaagagaaatttccagagactcttttgaaaattaagagtgaagaattaaacagaaaaactatgaatttgtaattgtgaacccaaaatatttttcggacttttatatattttatacaacttttagttttgtattattttttccttttagtagtaaaatataacaaattgggttttgacctatcaaacaaatccaaaattgataaatcaaagctgccatttacttcctgaacctccttttctttgcttctgcaccccctaaagaacaaaaatatctatcatcttcttcacctacacccgatgtcggagaagctatgttacgcctgctttgcaaccgcgtctgagggctacggcagcaaaatgctcaacgacttcaagaatcgcctagtcttagagctcaacaacagcaaaccagtcatattaattcaaaggttggaaagttgacaaaaatgtaaaatgcgacagcattctgtaaatccttttccaaaatagtgaattttttttaacattccaaaagggtgtttccagaattgggattttaccattatggaaagggctttccaaccttatggtttcttatactttaatatagataaatttggtcccttaaaaaacatttgaattttttttattgataagaatcaaaaataaatatcagaaaaattacaacaattcatacactttatattcaaccaattaaattaaacctccattaataaaaatatttgaatttaatcacacaaatgattccttctcccatgcaaagaatgtttccacacatatgttcgtgctctccaacgaaagtatatatatttttgggcaccctctcctacttcctaatttcattatgcttatttgtgttttattcctaactttggacaatatagtattatatacttaatgatttttattttattttatttggggggttaggaacgaattaatggccgaagaacatgatcaagttgaaaatagtatgaaagtcaactcaaggtgaagaaagtgctccatattaacttcatacaactactgccatgtaatatcaactcgacgctttttgcatgaacaatttcagtcacaaattttaaaagaattaatgaaatttacatgaagttgctgcaccttgaaaaaattaatggctgaagaacatgatcaagttgaaaatattacggaagtcaactcaaactgaagaaagtgctccattatacaactactggctactgtatgtataatcaactcaacgcttcatgagcaacagtttaagtcacaatttttttcttttttagaagcgtttctgtcacaaattttaaaagaaaatttacatgaagctgttgcaccttgaaaaaattatatttagtcgcatatttgtatacttttttgtattttttttatttttaacaattattaacaaagcaataacaacttgtacaaaaaggatatgaaaagtcaaagacagggacagatagctagcccaggagagaaaaaatggcattctctccaataattttcacgtgaattttagtatattggatgaagcacttctaatattaatcaagtattgtacgagagtttattatatacatcatgtacgtccttgacgacgctgctagctagggctaaaagccaccaaccccaaaagggaaaacagctacaaagtccacgctcttaattagtgggttgcacatgctcatcaccacttttatatttcgcaattaaatatttaaataatagaaactattaattctaaaccatcccttcgaaaatggattggtgcagcatattgcatggtcgcttatgtgttgcccacatgcatgtgttcagaaataatcattaagatatgtatcaacagaatgaattatttaccacttgtaagttgtattgtttaaccaacgggtcaccaatgccatgccaaagaacagttgcagatagagtatgtgctaactaggtattatataacccttctactggtagaaaatttgggtttcattcctttttaggcgcgcgcagacacaattattagcaaagaaaaaggcctcaatggataatgtattttctctaattgaataatgagagtaagacatgggataagaaattaaaggaacaagttttttctaatataattaaatgttataactaattataatgggtcgttactctttacatattaaacagtttgtatcctttactgtgtcgtgaaattaatacatatattgatcattaaaatttataaaaaaaaataataataactaaagcttaaaagattatagagagaattactttttttttttcttctgaaaaaatgcatatttatcattatatatatatatatatataatttaagatgtaatatgttatatctgttagggaagaaaaatatgaattttaacacaagaagggatgaatgtataacacttacagttgtcacacggaataaaagtgtaaagaatattttgataatattttttttaatggaattttaatgaatttttttaaaaaaaataaagtgtcatacactctaatctatcagggaagctaggaagtgtaaattttaacacaagagaaaaggacaatgtactatttatatctttaagaaaggagagtgtaacttacacatgactagttaaatatgagtttaaagttttttttttatgaatttatataaaattctcaatagttgatattctcttttatgacctctctcatatatcgattgatattctctattattgttaatataatttttaatataattattataaaaattaataaaaacatatatcacgataagttgtaattgaatactataatatgtaaaatacattttcaatgcaaagcttatcttcttgtaattcaaatgctttttaaagcaaaaaattcgttattgaactcaattaattatttgatcactgccttcttcctctacacttcttcaaattaaattcttacttatcaatctttcccaaaagtttaataaaagaaacaaatcctttatttttggtggagcgagagatattgggaaagcagggttttcgtttaattgagcaaaccctgattctccaattaccatgcaaatctgatgatcagcagaggcggatgcatgtgtatgattgcccccccttaaattttgggatcaagttataatatccctgttggaatggtggaacagcggtgaaattggatagtgcccctccttaaatttttgttgaagagaaagagaaaatagcttataaaaacagaaatggaaaatagaaagaaagtgccgcacacagcaaccaagaagaagaacaggagaagctaactttgtcttatttgagtctaatttgctttctgtacccactttttttttttgcagtttcatattacatttttgaaatgagcttttgagttttaatttatgtagttgctatttatagtcttttttattattaatatactttacttgtattatcaaatttaattgttattttggattttttaatatagaattatggatgaatttttttaatcaaataattttagttatatacatatatataatataattttaagcggattcataaccttgtacataaaatattgatttaaattttctttacaaaaaaaattttcgggggcgctgcccccgaacccccaccattaaatctacgaacataaaattattttttacaacgttaaaatgcccccccttaatttattttctggatccgcctctgatgatcagggtactatttaatttcccgggattttcactaaagacagtcgtcatgacattttttttttccatttaatattccctattcaattcactctatcaaacatatacacgaggtcctataagctttccatcaacttcctcataaaggcaccccgcatgaaagaaaaataattgactagtgaattaggagttatcacttattagcatgcatgtcacatattgcacctttgccatttcatgagctcatccaaaataaagaaacacatcaaatctgtaaaagcgcactacaaacttgatagtgaagaatccttggaaactttttctaggcttcccaacctgtccccaaagctactggcatcaaactaaagtggtaaaaaaaatttaaaaaatacataaatatgtttgagatcttgataaacattcaatttttattttgagtctctagtaattttttcattatatttctgatgtattaaatatttgttttgagttcttaaataattacttgacttcatctttataacttattaatcattcagatgatatcacgtcttacaataatgactcaaaataaaaaaatttaatatattaagaatacaacaaaaatatttattaaagacaaaaaacaaaaattaataatttattaataacctaaaatatatttaaaccaaaataaaattaaaaaagtcaccttaaggacagaggaagcagtaaccacagaaaggaataatagacataaccccagtaacaagtaagctttatgaaagcttatcatctgcaagccatgtgccaaaagtatatacaaaagcaataaaaaaagcatgcactcaagtccatccccttttttatctttcttttacttttgcacagcttctattgttttctgatttagagggttcccttacagctctgcacacagatcatcatgatcaagcttatttctagctaacatgtggtctctccctatatataaaagttagcagtttcgtgtaacgtttaaaataacaccaattccactttatttatttttatatttaatgtctaatattgttgatcaagtaagaatgtgtcactttccttattatactttatccaatcctaataataatgtagcttactactccacctatgtgcattggcatatattaatatggttgaggacatctcgtggggaatttgtgaaggctttcacttgtgaacttagaaatctgaagatgggtttcactgaggagttggtaagaagtgtcttctccaaaagtcgttctgatgggtctcatgaaaacaaagtgagtctctaatatgctgcacttattctatattatctacaaatttacaatagaaaaagcataaatgcacaaaacaactctcttagctcaatttaagttccaataatgttctcattgaagattgcattaaccagcttaatttgaattatggcctgctaattaacaggtgaggcgcaatagtgctgaaaatagaagatggttatctgtgaggtcatacttgtgtggtgatgaattcaattcagtccttgcagagaatgattcagcttcagttaagagctctgaagtcacggtttcacagtccgtacaggaggacttgttgaacgataaaggagacactgagagtgaagaaactgtggagaatgtagcccagaacaggccaagttcaaactccaaaaaatcattgagtgaggaagaagcagctgttcttattcaatcaacatttagaggcttcctggttagctcatcaaactttaattacatcaattttcttattcatatgaaaaattatatcttagtctaagaaaatattgtattcaagttaaggaaatagtgaaaaacatattcatgcgcttaccttaattgttgttggtactaagttcaaggagtgtatgagatgagtgaaaattgcaacactgaacagagaattgagtgtcaattttcacccttcccatttgttaatttctcccatttccgttactcaacccttttaaaaaatttaatgaaaaaaatgtcaatggttactttttagaatcttagcatataatggtatgttcaatattcatatgattcatagtttgttcattaatcatagcatatctggcttattagcatcactaatatgctgcacattacagttgaggcgtcaaaatggagaaatcaaatcacaaactggaaaagatgagttcaatttagtaacagaaagtccagacagaaagtccatgggcacatcaattgaagtccaaaccgcaaactctacggaagttttctctgttgaaggagaaaaaaagggcatttgccaccgtattcagcgcaggaccagaactcaagcaataaagcaaaaggtacaacagaagacaatgatgcattgtgaactagcactccatgattttggttaaaagagaaaaaattaaaattgagatatgctcaagagaataataaattcagaagaaaaggacaaaaaaattagacagaagtaccattatttaagacatcttccagaacatattttaaacttcagatgattaactaaaagagtggttaatattttatcaaagttttcttttaaaaaatgaaaaacaagaaccagaagagtgataagaagggtgtaaagaagatggacatgttaacttgataaatcatctttttaggttaatttgttccacattataaatgtgtctagggtctaggccaactaagtcactagctcaattggtacctccccaacactttgaatgtgatattgatgttgaaatttaatcttccacttggccacttttttcctttttattgtttgcattctccaatataaccaaaagtcaaatatatcaggatacaccttaattggtaattctcacttctcagcaaggtatttctatttcgtacaaccagtttctggcacacatggttttttcttgtttttaatataaagtcacaaaccaacgcaagcaacgttcgttagttttatacatagcacacattgtaggatttaagagtctgaactttaactgggacccattaaattggctataatttacaagttacaaccaatcaaaattctgttaagctgcatagtaacattgacattttcaggaagattgggatgacagcacagtaagtagctatgtttcaaaaatgaggatgcagaatagaatggaggcttcaacaaggagggaaagagcactggcttatgctttctcacaacaggtaaacactaaagagtaaacattatatgcacggatagagtgacagtataaacaaattttacactattatccaaatgcaaacaatcatgtacggtaagttttatgacttacaataattaacttaaaatttataataacaatgattctgattagttgataatgtaaaattctttacaccgatagtacatagaaatttaatgaagataaaggcacaggactggtaacaaaacactaatcctgattgttgcagctaagaatctgttcaaagaggaaatctccaaaatttaatagcatggagtcaaatatgagttggagttggcttgagcggtggatggcaacgcgccttccggagacatcatcagttgaaagccatgccatgaagcagtatgacccttctaatggtagtcacaaattcacaatcatgacaagatttttagatgctgctggggaagaaaaggagagctgcgggtcaaatgaagtgccccttcattttgataactattccatcaattcccgagaagaaaaagttagcttcaaaccacatacaccaaagaccaacttcaaagctaggagaactgtttcaaggcggaaaacagtgcctagttatcaattccatgaagagcagccaaaggtcagaatctctttactagttcacatgccatccaagtcaagcctaacaaattcatgattatgtctcaatgattttttacacgagtacactatcattttagtctccgttgttacattaatctctaaaattaaaaaaattaaaaataagttcttggaattacaatctgtcaatcacattagtctataattcaaaaaaatgtgactaaaataatgatactaacatatgttcaaaaaaatgtgactaaagtaaggatactaacatatgttcactcaggcaccaaaataaagataagtagttaagtttagaaacttaagtgaaacaactaataaattcatgaacttatttgaaatttctttaattttaaggattaatgtgacaggtttttacatttttagggactgaaaatatgattctctttttttaatatataatgtcatgatcacgaaagatatgtttagaatgcatgagcatgttgcttgtgtatctctaccatcttctaaatatagatttttaatgttcccacaggtaagcaaaagagatggttcaggcaatgctagcaaggatattaagcaaaaacaaaagcaagtgggaagcaggacagaaattacattaagcacctcgaaagcttctaatgtgtaacttataaaaaataaagtcaaagtatgtgtctagtattgagatgtaatggtttgattctctagtagattcttgattccataaatcttatgtgtacattgtacataatatcaagtgcaagattgagatggttgttctgatgatttgctttccaaaaattcattcattattaaatagaaaatgaatacaatcacaattagttgcatgatgggacactaatttttttaactgatcgagaaatgataatgctcaatgttaaaattcaacttcgtatattatttcatacaaaaccaatgtgtgttggtttaatagaaagagtttgaatatgtaatataaaacttaataatctaatcatgcttatacacaaattaacataagcaattagattaagtgcggaaaaattaagatcataaatacctcccgccattgctcacggtttttgagtctttggattgcactgaagatgtctcttgagtcttctaaactctgattctaaagcactagatggtgtatatgctgatgtatatagaatgagttcagggacccaagaaggctgtagacacacttatttatagaccccttgccatcaaatggtcagttacggtgtgctaaaagaagagacgttaatgttgcaaaaaaataggggatgtgggtaatggttagtttcctgaattattgttgaccactatcaggttggttacagatattttgtaatttcaaaataacaaccaacattctcccacttggtcgacatgtcccttaatttacatacaagaaataaaatgtatgaatcatggcgataagtcctcttaataatgagcgagtagtatcttctatgtattacattgcattatatttctcaagcccatacaacttaatgaataaacccaatgtttattctaggtccaaacttaattgatgtttctcagaataaataactgtagatgcgcataaactgaatgaaaaacatcacaatagagtttcttaatatcattattacaatgaaaatcatatatgagaaccaagtttcatcctttccacatgatccttaaatttgaatggtggcatgccctaaaggatcgacaatcattaattcagtgctaatgttcttaataaccactgtattatctttagcacattctcttatggctagatacttaatgtcgatgtctttgcttcgactacaaattttgttattcttagccatataaacagcatctgaattatcacagtatatcttcatgacttagaaatagaatccataactctaagtccagaaatgaaactccttatccatacaccatgtaaggtagcctcaaaacaagaaacgaactaaacctctatagtggaagtagcagtcaattaaggtctgcctgatacttctccaagacacagctccgatggctagcatgaaaatatatcccgaagttattaacttcaacgcagccaatgtagtctgaatctgagtagtcaatcacttccaaattgtcagtccgtctgtgcataagcatataatccttagtttcccaaaggtatcttatcactttctttgcaactttccagtggtctaaacctgggttactttgatatttccttaacactccaaccacaaaagcaatatcaggtcttgtgtagacctgagcatacataaggttttcaacagttgaagcataagaaatgttcttcatttgttcccgctcaagattatttttcgggcattggcttaaattaaacctgtcacccttcataatgggagctatacttgttgaacaatcactcattctaaatctttccaaaactttgtcaatataggtctcttgagacaaaccaagaacacctcttactttgtctcttgatgccaataacgtaagaggcatcacccatatcctttatatcaaagttcttagagaaattgtttaacctcatatagtaaacccttgtcattggttgcaaataaaatatcatctacatataaaataaggaaacaatttttgctcccactaatcttatggtatatacaatgattcatgacattttctacaaaaccaaatgaagaaataatgtcatgaaattttaagtaccactgacaggaggcttgtttcatatatagatttcttaagcttgcataccaattgctcatcctcaatagaggagaatccttcatgttgtttcatataaacctcttcctctatgtctctattgagaaaacttgttttcacattcatttgttgcaactctaagtcaaaatgtgcaacttgtgccagaatgatgcgaagagaattttacttagatacataagagaatgtctccttgtagttgattccttctttttgattaaatcccttggcaatgagtcttgctttatatctctcaatgttgcctaaatgagtatttcttagaaagactcatttacatccaatggcttttgcaccatcaagcaactgaacaagacctcagacttcattcgttgccatagaattcatctcatctttcatagcatcataccacaagtttgattctttagaactcatggcttgtgaaaacgtttcaggatcattttcagctccaatagtatagtcagattcctgtagatacacaacaaagtcactcggtatcgctgatttctttattctagtagatctccttaatgttgtttcattatcttcttgaggaacttgttgttcaattggttgatcaacaatttcttcttgctcctcatgaacaacttgatcaactagattatcagcaaattgtggatcttgaatgataggttgtgtaacatcccgggcactgacgagggcggggagtgatcgccggtgcagtgaggcacggacaaggagcggctcctggcaggcttccagtggaaggggtacatgaatgaatcgaatacacacccgaacgagagggatccagaggctgtgcaggtatgggactgtacagtttaggataacttaaaggatttaataggtactacctatactaacaaggtgcatctacttttcggtagcccgtaacataagaactccacagttaagcgtgcttgacttggagcaatcttgggatgggtgacctcctgggaagtttctcaggaagtgtgtgagtgaggacaaagcacactgaaaagtcttgtgttggtatgtagggacagtcgttgatcctgtaagtggtcgggcgttacattagtggtatcagagcaaggcctctctaccagtacggtgtggttcgaggacgaaccaggcggaagctggtgggcatgtaacatcccgggcactgacgagggcggggagtgatcgccggtgcagtgaggcacggacaaggagcggctcctggcaggcttccagtggaaggggtacatgaatgaatcgaatacacacccgaacgagagggatccagaggctgtgcaggtatgggactgtacagtttaggataacttaaaggatttaataggtactacctatactaacaaggtgcatctacttttcggtagcccgtaacataagaactccacagttaagcgtgcttgacttggagcaatcttgggatgggtgacctcctgggaagtttctcaggaagtgtgtgagtgaggacaaagcacactgaaaagtcttgtgttggtatgtagggacagtcgttgatcctgtaagtggtcgggcgttacaggttgcacaacacccggttgagctggaagggtattgttaataacaaccaatctaagatttaaagtggatggttgagtaactgaatgatctttctcagaaacaaaatttctggattgatcgctcccactaatcaagtcattttcaagaaattcaatatttcttgattccacaatccttgtactttgaaatggacaatacaaattgtatcccttagacctttcagcatattcaatgaagtgtccactaatggtccttgggccaagcttcttttcttgtgggttatatattttcacttcagatggacatcccaaacgcgtacatgtcgcaaactcgatttccaattcttaaattactcaaatggtgtctttgggacaaccttaattggaactcgattcaatatgtacactgtcatctttagtgcttcagtccacaatgacttaggaagcttggaaatactaagcaaactttgcaccatgtccattaaggtttggtttcttctttttgccacacctttctgatccgaagaaccagaaataatgtactgggcaacaatcccatgttcttgaagaaacttcacaaatagatcaggtgcttgtccattctccatgtatctaccatagtattcaccacctctatcagatttcacgaacttaatttgctttccacattgtttctccacttcggccttaaaaactttaaaggcatctaaatcttcatctttagaatgaagtaagtagagatacatatatcatgaataatcgtttatgaaggtgataaattatttcagactacttacgtccatgtctggacaaaaaatatctgtatgtatgatttctaatagatttgagctcctctttgcaccttcttaaacttgttagtttgcttacccttaatgcaatctatacaagtatcaaaatcagcaaaatccaaagcactaaataccccttcatttactaatatcttgattctctcgatagagatgtgtcctaatgttaggtgccacaacatagagaaatcctcattcataacacatcgattcatgccaacaataacatgcatagcatcataagtggtatcattttgcaaattaatatagaaaagaccatattgcaaatcaatccaccatgtgttatgattaatcatattagattcataacaaactaaataggtaggcatacatttcttttccaaaccatagtttgaacttaggacaatctttcttcatgtgcctcttccttttatagaagaaacacctggattatttcttaattccagcttgaggtagtattttaccacttcccttgttcttatggcctttcttattcccttgttccaactgcaacctcccctcttcctgaatacacatggtcatgagttcattaatagaccatttatctttatgtgttgtcaggtattttaaagggaccacatggtgctgggagagtattcagaataaaatgcactagaaaagagtcagacatgtccacctctagaatttttaattgagctgcaatgtccctcatatgcatgatgtgctcacgcacacccctcagagtattgagcttcatggaagaaatttcattattaaggtatttgtcaatgtctttcctgaagtttcaaattgttcatcaatttacttcaggagtcagttggatctttctaatactcatacagatccatctcctctgattcaccattctttataattgttgatagctcaactttaaagatagtataatcaatgttcatataccctaatgtcagcaaattccttccaaatagaaaatataatctcctctcaatttcgggacaacaattgtattaataggttgtatagttgcaaaataattcaacatatatgcttatcattaaaatttgagacaaaaataatgtatcatgatttatcaatgtaagtcatgcttataaaattatgaatttagcgatataaaatttgcctgtgggctaaaattttaattctattaaattcacataaacattatgataaaactatcaagttatatttcttgatccctgtgggcaaatcaaaaaatataatttaatatcttatcctaattaatcatacaaaaatataatagaaattcctgtgggataatatctactatattatattatgattaatcacaattaatattatttaccttatgtgatctagagactcttaatatataatttaaataattaaagttgctgtggctaggctttaatcaattaaattataaagatcactaaatattgtctaattttcaaaaattaattttactgtaatcaaccataaacaataaaattaaataatcaatcatttagattaatcaacttaatattacatgtatagagaaacataaattaatacatgtaataacagaataacaataggtcatgtgaacatacatcacaaaattgtcattagttcaattgacaaaatactttataaccatttatttggttatgggaaccccatctaatgcatttcattttattttgaattcttgaattgccaagtcatgatagcataaataacaacattagcataatgcctaatgctactcgtacccatatcacaaccgttacacaaatcaaaataaaataataaataaaataaaaatgggaatagtaacaataaattacaatataatgtctaattccttatatgatctttaaacaacttaatatataattttaattaaattatagatattgtgactaatccataattaattaaaattataaagatcacttagacataaaacttaattatatgagaataaattatattatacacctcaagatcaagatataatataatgataaataaaattctcatacataattgcataattgaaacataatattatgcatttgatttaatatagatgcatataataaactctaccataatatattcatgcataaacatataacatacaaataaaacaacaaaatatcaaatagtttcatgtggcttagtggttgatgtgagtatcatttaagtgaaactcatgggttcaaaccttttatttatttattactattcatcatcttcaaccttgagttgggtcagtttgacccaattgcaacccacggacccgaattaaaaaaccaattatttttcagcctttttcaacaccgaaatccatgttttaatttacataaactttagaaactcaatttccatatgattccaaagcttcttaataattaaaacattcaaataaaatactcatattttaataaaataatatttcacatatatgagtgttaaacaaagcaaggcagaggcaataaacgggctctgataccaaatgtaatataaaacttaataatctaatcatgcttatacacaaattaacataagcaattagattaagtgcggaaaaattaagatcataaatacctcccgccattgctcacggtttttgagtctttggattgcactgaagatgtctcttgagtcttctaaactctgattctaaagcactagatggtgtatatgctgatgtatatagaatgagttcagggacccaagaaggatgtagacacacttatttatagaccccttgccatcaaatggtcagttacggtgtgctaaaagaagagacgttaatgttgcaaaaaaataggggatgtgggtagtggttaatttcctgaattattgttgaccactatcaggttggttacagatattttgtaatttcaaaataacaaccaacatgaatatcttaagtaaatgattaggttaataacccatcctcgaatcaaaaatatcctcatcatttaccacacgagataaaagtaaaagcacatgattcacgtgtatgaaatcaggttgacgatgatatcataaacaaaaaataaaataaaaatggtgtcatacaaaaatctaagataatcctattatatcagcagttaaagctgttatttaatagtaggaattaaaactaaaaatattttaataactaaaacaaaatacaagacattttatatgaactaaattgtcatttaagcctataaaaataattctatctacgacaactaacgatttctttaatttagaaacatcatacattatattaactttatttttgaaaatcactccttctaaataatacaagaaccatgcgaaccagctttattcagtataacttagaccaacctaataatccctttttccaaccattcaatttctataatataaaacgttaaaaaataataatcataattcaaaatgatgaattgatgatcatatgtctataaaaaaataattaatgttaatggtcagtgaggatgtagacaagttgaacacaaatcaattttgtcttgtgtaacgcccgaccacttgcaggatcaacgattgtccctacataccaacacaagacttttcagtgtgttttgtcctcactcacacacttcctgagaaacttcccaggaggttacccatcccataattgctccaagtcaactgtacagtcccatacttgcacagtctctggatctctcttattcgggtgtgtattcgattcattcatgtacccctcccgctggtacctgccaggagtcgctccttgtccgtgcctcactgcaccggcgatcactccccgcgctcgtcagcgtccgggatgttatatcttgaactagaaaattataatgctttatgcttaagtttaacttattagaagaaaatgttaaacagcatgaatttgtgaaacagcacataaaaacaattactcttgaattcctcgtatacttatctcttctaattatgcttttcatttttatttctgaaataaattttaatatttaaaaaataaataattaaaaaatcttataacaaaaaataaattatttataaaaaaactaaaatacaatttacataatcaagaatatttttaatacaatttttaattataatataatttgtatattaaaaaatatttattataattttaattatataaattaaacatttatccttcccaagttacacttcttttttcccatttgctgttagtctatttaatttcaagtggtaagcattttccatagacatgttgtctaaagaaaatagctgtattttactatgattcatgaatggtttcttttggaatgagaatattagtacaaaagtactgttataaaaaaaatattataaatattcattgtacaaataaataattttttttagaagaataaatctattttttaaattagccggtgtttatttttctgttggataaactccaaatcaatttgggcactttggacttttcacgtccctcaccagtgtttctgagtcctgggaaagattttctcccttctacgtttttgcttcccctacgttcctgcagcagatgatcaactccaatttccgcgaaccacaaatcaaaatggcacctttctttgttctgtttctattagcctcttcattgactcaagggtatgctcaatttcaaccaaaaaacgaagcttttatatccttgttgattacccaaaatggccttgactttgtgaaggagttgctggtgaacaaggcaatttcctcactggtctcacttcgattgccaaatattgaaaagactgcgaaaatcccagttgtgggtaatgtctacatggtgctctccaacatcacaatttatcatatcgatgttgcttcctcgcatgtcaagccaggggagactggaatttccattatagcttctggggttacttgtgatttgagcatggattggtattactcttatagtacatggcttgtgcctgttaagatctctgacagaggtagagcagaagttcaggtatgaaatttattctttattttgtttgtttatatgaagaaagatttaattagaatgcaatttcaaagttattttatactgtcctccaattgaagattgtcagcaagtttgttgatttttataataattatttaaaagtcaattcaagatggtttctgattagttcacaatggcatgcatgtgttgcttgttgtttgttttttgttgtttgattggaatttataagtgttacttgttgtttcattggaatttatatcttaacttgtttaatttatattgtggattttggtatctaacaatgttaacttgtttaattataaataaactgcgccatgggctatggcattcagtatggaatttatatgtggtattcttgttttacttattttatggaaagttcatattcttatattggtatatgattattcttgtttgtatgggatgaaaatgatatctgttttatctttactattatttctgtttatatctgtccatcttcttcacgactgtaatcagaaaggaatttgattagtgctactgttgtaaaggttgaaggcatggaagtaggacttacattgggtttggagaaccaggaagggtctttgaagctgaaactcaaagactgcgggtctaatgttaaagatatttcaataaaattggaaggaggtgcatcttggctttatcaagggtatggaaatatccatattagattcaaatttcgagctcataaaggaacataggtttcaatgtttcctgtatcttttgtagcattatagaacttgtgctggctgcttatcctttctcctttaagtataagatgccttaggcctgtttactctgaatttttttttcattttctatttgtaaccagaaaactaaatggaacacaaggtagcattttgtaattaggagtgaaaataagaaatgaaaacagaaaacattttctcaaactaaacagctcgttacttttcttttaggtggttttctcaaggagaacaccttagctcccccctaatcctctatgacagggattggaagcttgctggatatcataatattattgaaagccctataatccacacaatccgcccttcatcctttttcttaactaaaaattgtaaagttggaataagagataatgttagaccggattatgcctgctgctaacagttacaactaagttcttttgttttttaacagttacaactaagttagggggttataatcccctacatctctcctatttttcctcatataaaccctggtaattggagggcctttcctatcaattcttctctttataatctagtaatcaactgtttcaaactggtcacttatttctagcttagaaacactatccctatctatcatcaccaccaggaggatttttctcctttaatttccaactttttccagctactctggtgaaacaatgctctaacatggtattatttaaaataggatgaaaatataccataggatatgtgttgttgtagttaatgttttctgaaattttgtaagtaaacaatatttggaggtttccattttccagcatatttagttttatcatcatctattcatacatttccatgtcacctttatctggcataaaaatgattttatggtttttgacttttagttttggttaatatctaacaggatagttgatgcttttgaagataaaattggttcaacagtggaaaatgctatcgccaagaaacttacaaaagggatttcaagccttgactcgtatttgaaaagtcttccaaaggaggtccccgttgatgatcacacttctatgaatgtcacttttgtcaatgatgttttatttagtgattcatctgtcggatttgaaaccaatgggttatttatagaaagaaaggtttccctacctattcttgacctcgacgacaagaactcgaaacttccaattttatgcacaaattcatctaaaatgctagggatcactttagatgaggctgtttttaactccgcatcaaccttatattatgatgtaagtttagatggtcggttatgatcttaaatcatgcacattctcaaaatattctatttttatcattggattggctcaaagaaaatgcttactgtgttcaggcaaaatttatgcactggattgttgaccaaataccagatcaatctctactgaacactgcaggatggagatttattgttccccagctgtacaagaaatacccaaatcatgacatgaacttgaatatatctttatcttctcctccagttgtggagatttcgaatcagaaagcaggtgccaacatatttgcagacatgacaatcgatgttttggaagacgatgaagtaataccagtggcatgcatatcattggtaatatcattaatatttatgtgtatgccttattcatcaccattctgaatattactaggatgtactagatattatgttatgataaattctatgggctggtgtggatgtaaaatgaagttcagcaagcttaattgtacaactttgagcagctctctttcatacccttttttctattaacagaagctaatccatatcagtctttgttagtacggtcatttatcttaaaacttggctaatcaatcttccagtctgctggattggcttgttggtcaagtggtcaacagtcattgctaggatagtaggttgttttggctgcagactatttgtgtttgccctgtatgtaagactcatgaatatttatcagtttaagggattgctataaatgattgcttcaactcaataatatatttttgattattcaactacaatgattgcttggtaagaaatagacaattttttgtttcctctaccttaccctagcatcgggaaaagctgagtttaaagaaccaatcatattagcagtttagttttgtagtgatgttgcaattgattgttattcaaatgaaggcttaagtgcaattttagtccccacattttgttcgatctgcaattttggtccctccattttaaaattaagacatttggtccttctattttaaaaaatctgctattttagtccttccatttcaaaaaatagagacatttagtccttctatcttagaaaaaaattcgcaattttggtcaaattctcaattttgtctacgttttatttcttttctgaaccataaacctaactattcagttaatgtaccattaagaaattatttaattagttacaaagtaagaaaataaaagaaataaaacgtaagcaaaattaaagattaaaccaaaattgtggattttctaaaacatggggaccaaatgtttctattttgaaataggggaatcgaaattgcggattttttaaaatgggaggaacaaatgttttaattttaaaatagagggatcaaaattgcagattgagtaaaatagagggaccaaaattgcatttaagccttcaaatgaattactaaagtttgtcataattagtattagtaaggtgctacttttttttttttagatatagagtaaggtgctactttgtttttgtgtatttgtgcaaggaatatattttatccagatactatgtgtatctattcaaccactggcggatagggggcacataattaaagaataatcagcttaaaataattaaagctaacatggtgtggtagactatgttagaatattgcgaatctcattgtgttgggaatcttatgatgttagtataataaatcttattgcaccagcatatactagttatgagtttttaagtataaataggtattagtgctttgcatcacatgctatattttcatcagatgccaattattcagaatctcttattttccttttccatctaaccccccataatttaaaattggcattggagctgtgccaccctccatgacctaatcctgtcaccaacacagctgccgaatttgcaaagtttatcagatcatgtattgcccctgtttgttgttgtaatgaattgttcctttacaatgaatgaccgctatggctacattgcatcttgtttacacaggtaattcaaggtacaggtcttgtcaaaatcaaaggaaacaacctcgtaggttctatcagattgaatgactttcaaatgtcattgaaatggagcaacattggcaatctgcggatgtacctcattcaggtgcctttatgtttcatgtttgtataagacgcgtgataacaagtactaaaattttaattctaaagtttctcattaatgaaggatgtgttgtcttttcctactgcagccagttgtgtggacgcttattgaaactgtcttcttgccatatgcaaatgcacgtctgagtaaagggttacctttgcccatcattcatggtttcaccttacaaaatgcagagataatcttgtcaacttcaagaattgcagtttgcagcgatgtagcttttgcagattcaaacaagcgttttcttcaatttcattgagtacataaaagagtgtgtggttattgttcatggagtgtaaatagttcaaatcagaaatcaagatgatacatctacttgtgcaatcttatttcatttgttaattgctacttgctgggaaatggggcaaccatctatacaaactttgatacaaatacttgcaccgccagttatcatgtaagtagaggtttataaaaccttgcaaaagaacatgtgcacatttggattagagttagtatttgaataaatttgatgttacaaacttggttttgattatgactgagtagattaaaatcattctagaaagcacaaaatttaaacaaaaaatcataatacaccaaattattgctccataaatatgggtccataaaagaaggagacagacatctccaatagcaaagtgaaggttcttatgtaaaaaaaannnnnnnnnnnnnnnnnnnnnnnnnnnnnnaatgagataaaagttttaaatctaaagtaaagtataaaaatatatttttcacattatttatgattctttttttttatattacaaacaaagaaagtatgtcctatatattataagagtatttaaggattttacatgtcctatataattatttaagaacttaaaataaatttcacatattatcttgcaaaataattttaatcataacttatatttgaactaatttttgatatcaaactccttcatcggcaatccctcataaaaactaatccctcataaaaactatcattgtgcaacacaattatgtatttcttatttagttttttatataataaaaacttaagtttaaaacataaaacatgttttgttgattacttgattctgattattttttctccctaatatataaaatttaaaatataatcaaaatcaattgcagtaaaaacatcaatttttattttctaaaatagaaaagcgaaaagtaataattatttataaaagagaaagagagtaagtaactttaaaattaaacaattttcataaattctaatactatatcatcaaccctgtcttcactaaaaaaatactaaataaatacattgtaatttttttttttttgaaaatgaatcatttaaaagaaataaaaataaaaataaaaatgttcttctcaaaggtcaaaacgacagtgttagcaagttaaccttatcctccaattccatcacaaaagtaccggtggttcaggccgacaccaacgttttcaaaacccacattaaaccctgctttctccccctctctctttctgttccaattcacagagaacaatgcaaatttctcttagcaatttagccttcaagacccctcaactcttcccaatacaccaccccattttccctccaaagccaccactgaaccaccaagtttcaacgcagagccatgtcaacaatgtcctgaaaggttcgtcggggtatttgtccgaaatcagcaaagcgattgatcacgaagaacagtaccgggtagcccggtcgcaggttagccgtaaagttttggacttggaaggttattccatagagggtctttcagttggaggccaagagacatgtatcataatccctgagttcaagtgcacttttgatattgggaggtgccctagtagggctattcaacaaaacttcctttttattactcatgctcatcttgatcacattgtaagattctccacttttgtcaccaataaccttttatgtgctggtgtttttactttttgggattagtaaaaaggggggaaacgggtaaattacacatgctctgtcttatcttattaggttgtattggttattgacagaaaagccagccaattcatacttgattaacatggcctaaaggctgtttagtatggaaacaaaatgtcttgtttttattttctgctttaagtttatatatgaaataatgaaaacataaaataatataaagctattttcactgtttcttgtataaagttttgaaaatggaaaataaagtgaagatgctgaaattttttgtggttcgatgtgaaaactgaaaatgaatgtagaaaaatgtttcctcaaaccaaacagtgccttaagtttttaatgttagaactcaggcctatttgtggttgtaacttgtaagggatcgttgatggcatacataggcatgttgaatgccaattcgattttagaggaggtttgggttcaagatgcattggaaaatgggattttagtaaaccaaacacactctaaaaacaacttacataatctaatgctgccctttctttttggaaggcatcaaatacctgtgaatgtgcttttgcatcctagtaatttgtttgtaagttatatgcattatgtgtatcctgtactttggatgtaaagtgtaaatttagcctaagggtgtgatgattttgaatgatttagggagggctgccaatgtatgtagctagccgtggtttgttcaatttgaaacctcccactgtgtttgtgcctccttgcatcaaagaggatgttgagaagctgcttgatattcacagaacaatgggccaagttgaattgaatgctgaagtggttgctttggatgtgggtatgtttcatttgtcttccgttaatgatcaggaaatatcttcaaggaatgacgtgtgaaatttcattttaggggagacgtatgagataaggaataaccttgttgtccgaccattcaaaacacaacatgttatacccagccaggtatcttttgatctgcattctgtagcccttgtcttttaaatgaagggtatattatatcagttttagaagttacctcattccttgtacaaaaaattggcccaaaacttaacaggtttcagcttaccatatttttgttgtcatctatatgaaattttgttaagaaatgccatttgggcattcccacattttgtctgctgaaaacacatacatgttttatgcagggttatgtagtctactcaatcaggaagaagttgaggaaacagtatgcacaccttaatgggaaacaaattgagaaattgaagaaatcaggtgttgaggtttgtaatattggaattcaattctgatttaagtcttctttgatctttacctttaatgaactctgctttctagattaccgacatgatattatcgcctgaggtggccttcaccggtgatacaacatcggattttatgcttgacccgtgtaatgctgatgcattgagagcaaaaattcttataactgaggtacgatacaatcttttagtgaaatgggtacaattatttcatctcccaagttcagcagacttttagaattgactgcttgatctactgaaatccttagaaatagagaatagctttatagattcagatctcaagtatgggacaataatatgtaagaagttttagcatcaattatcaaaacagccttcaagtctatttcattccataaatggacttttaatttagtcgttccttaactagttctttatgatgatcatgtttacaacttgaggtattgtcatgggaattttaagttaaatttttattttgtgcttggttatagtggaattggaaggaatgagaacaatagtgaaaaggatgagattatagatttttatggttactagttcattgatagtctagggtgtttctttccttgatggatataacaaaagattgcatgcccttttttatttttggttatgaacttatgactttcctgcttgctttctccttatgtatttcctggcagatttcttatcctttttctgtcatagtccttttctttttaaatttgcctttccttttaaaggaagagcaagggggggagagagagaaggatttcctgcttgtcatcctttcctctcattttttttaacaagccttttcctctcttattgaactctcttttatatattaaaaagaaaataattgttgcttgcctatacaaaagtgaagaatatagaattagagaatgggtgagcggctacaagtaaaatcttgtcagtaataaatcatatttaatgattttaatcttatatgggatattctctctttttcttttttcccttttatgtttaaccttttcttaatcatttttttctgacaattaattgtgacaatatcaattaacagtgaaatgaaattctttttattgtatcccaaaggtttgtcttcaccagttcacctaagttgatatcatcattacttttagactctgctttacttgaaaaaggaattaaacaatttcaaaaatgctattgccattttttgtagtgtgctctgacttctttattgctattttatttttctcttttttgtgtgattgatttgcttgttgaacctccgttaataggcaactttcctagatgattcattcagcgtagatcatgctcggcaacatggacatacacatttatttgaggtatgcaacatctttcactctgtcatggctatttatagttagcttgaccatatcaaagatgcacaaaggccaccttttgcagccctctcatacttgccctttctcttttatgttgctgtcttgtatgactgaggcagtgttcatgtttaatgcatatacatacttatcataatgttttcattatcaacagcttttgtgccaaatgttacagaagagttcaaccaagtacatagcttattagtcatatactatgttgcatttatgactcattttcatgtcatttcaagataaaaacctggagtctctacctgctcagacaaattctcagaattatgactactgcatgttatatttgaggaattcccaattagtaaacttatgttaattatgtagatcattgcaaatgcacagtggattcgcaacaaagcagttctgttgactcatttttctccaagatatactatagaggtaatgttatagtttttcttttagttttttaacttgcaaattgcatcccccaaggtctcatatctgcatggataccaattagatgcaaaaatccaagaattgtgaagtgtcttgaccttcctcttggaggggggcatattctcttgtaccaccacattaaatatgcattttataaaaagacaaaatttagatgcaactccttaagtgtttttgttggtgttgttcaatcagaatttaagttttaccatgataatttgtttaataaacatctgcgttaaagttcagcacagattatcaaaaagaaattccaattctgattagacaccaccaccaaaattttttaagaacttacatctaagtttgtccttgtaataatgttaagaaatttgtgcctcttttataagatacgcatttacattcttgatcctcaggatattcgtcaagctgcatcaaaattgcagtccaggttgtccgctaaagtggttcctcttacagaaggcttcaaatctatgtactcttaagtgttccaaatcagtacatcaacgattagagagagaaaaaatgtcactagttgtatctccgtttcatagtttcttgtaaattagaggtatatttgttttcagttttttttaattaaattaaatttaacttgtaagctttctatattagcgtgaatgagtagtctctacccttatgtaacttacaattacaattggtacaaccttaaagattatgttttgcccaacattaaagtctgtttcatatgtatatgcaataaagcattggttgatagtgtttttggcctaataataagtttgatttagatatctaaattgtcttgattaaagtgataatttagttcggtccctcaaaagaattaattacgccaattttattgttgaaagagagaaaaagttaccaaatagtcttttgaaattataaatgtggaatacaataatcctttaatcatcttttacttccttttttttttacataattagcttctggaagagcaaatcacgtatcattagtccttacaaaaattattagtgaccgaagttgattctttaaaacgttaaatagacgaaaaaattatagagttttatgtctacaatttttcaaaagtattcgatttatgtagaagtaaattaggttgagtgaaatttttagggactaaaatgggtgtctaatcttactttcatctatgattatttattatacgttgattattttttatgaatattctatcccgtttatatttttgttcttactgtcaaactttttgggatccaagttttctaaagtagataatttattttaaagagtataataacaaaactcagttgatgaataatattaatagttaatatttcatgtacatacataaataaatcatgaatgtgttaaaatattaatttttaatttctaactaacacctaaaattacttattattcacataaaattaattattttagagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttcttcattataatatgttcaaagttcaaacccgtgtggttcatttggcccctaaaaaaatcatctctaaattcaaacataataaaccaaaaagtaacatttagtctttttaaaataagattgaatgtattttttttttgttagaattaggttacgagttaattcagtccaaccaaaattttcataagattttaagtttttcctttttgaaaattaggcataaattataataatttttacttaattaataagcataaaaagataataatattctaatgatagctatacaatttgtttagagctgtgaattataaatatttattagttctaatttcttaattttatgacttagttgtgcatagtgtttaaatttatatatttcatttaagtattgttaaattcagtcctaatctagtcaaaccatacctaactcagttcgtgagtcgaaaacaaaattccaaactaagacgtttttttcttcttgcatatatgcaacaaacactcactcatcatatgaactgtgcaaatataaattgatgtgtataagtgtaagtgtgtaatgtttgttttatgcaaggaaaatatttttttataataaaattacaaaataatataggcagaaaaatataatataaccagcaatcattttgtataacgcaacggtgttttttatattttgttaaaaattcaaaatatattataatcaacctattattgagagtagaatgacctgtgtgcatactctcttgagtgagtttcttcatgttgtcgcttctaaacttttatattaaattatgtccatattttcctctttaattaattattctttattgaaagtttgaaattgcttgtatttatatatttttatttattttattattaatgaaataattttcaataatcagtcctcttttattttaatttatattttatcacatttgacccgaattgacaaataattgtatagtgtatgcgatacttgttaatttaatatgtaaaactagagtgtaggtaaaattaattgcatagttttgaactaaatgtggaaattaataaccaaaatttagaaatgcccgattctcttggtccactgcattaatttcatgcatattttgtattttttaaaatactttttattttattttttatgaaactacaaaagtagttgactatgatttatgtgagagagcgcctttgaaccctgtcaatttcactgcaatagtttcatcatttatgtatgtatgaaatcataaattatctttggggtgagtatttgtaatttttattaaattaattttgaattgatacgaatgtttgaatattttatgttaaaaataaattaatagtaaaattcagtatattttttatatataatttaaaaactatttaaagttattctgatacaaaattcattttagaattaaaagtaatatcccaacctaaatccaaacacattcaaaattcaaattaaaggaattcatcataattgagctagctagttgtgctatcatatttggtaagttaatttggcagcatttttctatgtaagctgcgccaaactcgtgccgacattcgtatctaaggactcatttttgtggggccaaaggcatggaacttgacctatcaataacagagaattgacataaatttgactatgatatgccaaaaacaacacatcataaatggataaacctctccacaaagtcggttgatagataactgaatatattatgtgaattgattaacattttattatgactatgtatgtatgtagaaaggatttgttacttgaggcaaaagacctatttggaaaataaacttttctatcgagttaaaattaattttatactataagttaaaatctgcttttagaaaagttaaaaaaaaaatttatcaattagaacatatataacccaactttttttgtgttatacttttctttttgtgcttaaaaagttataaattaattctttcaagtgttgaaatctatttaaaaaattgccatattctaataggtgctcttttatatacacgaatttagagtttgaatcgcttatcatatgcctaagagaaaattttatctattaactatatcaattcatatgtattattattagcatggttttaaattaaattacacagcagatgtgattatattactgatgtcccgtgttgtccggatgatctattatcatatatgattcgattaaagggggagaattttattttacttttttgtcaaaaatcttgataatcactataaatattttttttctttgataaaatacacagagacataatctttgaaatagcgatgttaggatttaaaattctaattgatgacgttacatgtaaagtttacctgaaatactaattcgctttcactaccaaacatattaggtaaataacttgtttgtttagcttagctaatagccaagatacttttacaatataataataatagtataaaacaaaatgggcttgctcttgcttcaaattaaattactctaacattgacttaatgtgtatttggatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaaatacaactttcttacagaattattaaaaaatattatttcattctaattatatttctaaatttccttaaaaaaaactacatttctaaatatacataaaaaaattatatttctaaatcaaggttcaaaataaaatttataaaggctaagcacttagttttgttaaaacttaaaagaatttaatgatcaaacacttttaagttagtataacttctaagtttattattataaaaattaataaatttatcatacctaaaatgagttataactgaatgataatatatgatttttttacactgttaatgtatcacctattttattaaatttaaaagactttttaccttaaaattaagcataatgtaatttcaaatcaaagttataggtacaaaagtagtttagctttattaaaacgctcaaaatgaaagtatcgatgcttaagaaccaagtcatgacaaataatttatttaaaaaaagagtaaaaacagtaatattttgaagaaaaaaaattggggagacgttttttttcagtcggtgaaaactttcttgaaggagagaatttatttccattataattgttaatatgtattgggcacagcaagctagctaatccgatctcactacaatggtagttaggttaaaaaaatgacacgccaaaaacagatagtattgatttaactcacttaacttatgaaataggtttgaattgggttaatatgttagaaagaaattgtaaaatgaaaatagattaaaactatttgggaagacatcaatcctaatactcctttgtccttcaagaatggtgcctattggtgcaataagatgttagttggcttagtggtggagttgggcatccaatcacaacgaaagttggctctctcacaatgaccacctgcaaacactctgatagttaagataatagtgattttatcatagttttgtgtttggatgggaaaaaatgtatttatatgaagtcttgggtgaaggtacttatgggggaaagggaggtgacatgaatggatagatcattagatcatcttgttagtcttttattgcttttacattagtttttgagtcaaaaggagatcaacaatatgtgtcaagagaaaatgcctataatttatatcaccaagtccatgcttaattaaaaatgtgcacattttgtggtctgagatgattttgccatgcaccaacaagataaactaccgagatgccatcctgggtgttgagacgaaagtgccctgtttgattaggccaggtccttagaccaatattattgggcctaagatgggaccataacatatttttctacttaattactaatatttccttttttcatactgagttcactattcattgatgaagcatcatgtttcattcatcatcaactagagcgacgaactaccatttgtgaacaatgaaatggagtacaagcacactacttgaggagaggtcaaaacaattatatttcaatttgagtgttagttatggtgtttagagatttgaattttgggtaaaaatatgtaggatttgtgtgttgacggaataatgagatttgaactaaaaatagacatatgaaataatagaagaaataaaaaaaattaaatttttatttgttatatcttattcttacattgatttccaccttattcatgtaataataataataataaaaaagttgaaatcaatgtaagaataagatataacacgtaaatatttaataaaaaaatttcttctattatttcatccgtcttttatctttagttcaaatcttattattattaactaactgttaatattttttcctacttatagcaagaccttttctattttttctaatccaattttgttaactttcatacttcataccattatcacctaccacacaacacattttatatatgaaaatacatgtatctatatcattttgtagtatacgtctatacgatactatcttcttctttttttataaaaaaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttattatacttgatgtaatggataagactattttaacttattctaaaaatataagattaaattgaatttttttgaaaaagatattaccaagaatattaattaatgaattaaaaagaaaaaatatttattatgaaaataaaagtataaaaaaatatacaaaatttactaaaagaaaactagaagaacttagaaaaaaatatttaatatatcgattttataagattttatataatatgtaacagatgaaaaatattttaataagatctaagtaaatcctttagagcatttttagtataagattttaagtaaaaatattaaatttaaaatctaaataaaagagataaataaatcttcaatgtagaaaataaattcttaaaaaataatccttaaaatttataaatgtttaaaaaatagaatatatcttcaatcctacttaatattatgaaatatataaaaaagtgatataacatcatagtttgattgggatctagtctaaattaattagttgtgtttagtgtctcaaaatatacacaatttactaaaagaaaactagaagatagggggagaaaaggcttttcgagttatgatgaaaggaatcatgattatttacccgaaactaagagggttgagtgtgaggcaagttgtgtttttacgagatctagtctaggataggagaataagaaacctggattggtcacgtgccaactaagaatctcgaagcccccaaaatccaacaactaatacatataccaaaaaacttcaccgctgtgtcatccatcaccccatgaccatgatccaatccatccaaatccctctctataatgccttcatcaaaatccagtagtaggaacgaaacgattgagtaatcctaacttgatgatactagtccttagttgataacattattatcacatcaaacttgcaataacaacgaaacttcctaaccatttctctttctctctgttttcacttctctctcttctcttctcttctcttctcgtctttacatcacaccctctttcccccctttgccaaagctctaatattttctccctccaatccccgctactccacttttcttgatttgggtgtctcgttttctcagttttgaatcctttttctgttctgggtctttctcctcttcgaaaaggatctgatttttcgccctgttttgattcgaatccctcgcgaaccctctttctcgatctgggtgtgaaggaaaccgttttatccttcaattatgaggaaaagggagagggagaatccttgtggcgtgtgtggccactatcacaaatatgaagaaggggaagtgtgttcgatttgcggtcaccgaattccggttggatcggagaaaacttcgatacaagttagtgcttttccatccgttgttctgccggaatttctttacctaggaagctacgacaacgcatcacgctcggagcttcttaagactcaggggatttctcgtatcctcaatgtaagaggggtgttattgtctttttgaatctggcatctccgcaatttcaatttttcgatgattatctatgaatgtatgcatgtgttgatgtttactgtggaattgtggggatgctggttggttaaatgttgcggggttttgtttttgccttgggttattatgttttgttgtttgaggtttcagtttttattgagtaattgcaggtggtgtgttttaggttaggggtttccttaacaatactcttctagtttctaagtggccaatgatgtttgagtctttattttcttatactaatatttattgagtaatttgtaggtggggtggtgtggtgtggtttgggttaggggtttccttaacaaatactcttctagtttctaagtggccaatgttatttgtgtgttaatacctttgaattttatgtttgtgcagaccgtcccttcttgtcaaaatctatacaagaactcgtttacctatcactgcctcccagatgacaaaactttgccatttgatgaagcaattcagtttcttggtatattcttttgtgttcattatacttatcatttcatttgcttaggtgcttctttaacatggatttgcaatttttaattaatacctatcaaacattatacttgcacatagtattggaactattggaacgtcagcctactcttcatgcttaatacaaataagtgatctgctttgtgatcttctacctttattgcatttgttatttcttatttttttcaaaaaaaggtacaggatatgttgtatttctgtcatagtggttgattgttcttctaaaagaatgggcacatttcctttcacgatgcctttcgcacttctactttatagattgctctatgaaccatctagtcaatttatgtacaattaacaagctgtaaatggaaaagaaaaggcaattgtagaatcacatagacctgggatgtttgttcttccgggtctcaaacttatctttgtacctccacctcaaaaaccttgttcttctgaaactattctcacttaggttgcaataagaaattacttcattctgttatatttatgaaccactctactcttctctttgaaaccaaatgttgcctaaaattacaatgtcgtattttgtccacttttacctatctgtgagtgttctcaaaaggacccgcttaaagtcaatattgaagaaagattcttcagcaatttgattatctgagagcatcctggccatctatcagtgtatcacaataatttgttatattttttcccctcatcatcagcatctatatccatgacttcaagttcttgacatatttaagattcttttaggggcttagactttcccaatagtgcataattgagttggagtaaagtagaaagctttaatctatttttcttatcagtgagcaccatactgattgtgtactgagataaataccatggtgaatagtggcgtggagaccccccaaatgctgtagtgggataccggatgaccaccattttgactccgacatagatttaaattgcacatatatatgctgaaaaataaacaaaaatacctaaaagtaggtataaatctggaaacaattgaacagattcaatgtaatgcaattagtataaacaataaagaaaaagaagtttaacactcatgaatctggaaatgcaagaaagcttccagagaaaagagaaagtatttgaagaaaaaatcttggcctgtccaactaggttaatcttctattgaaaaccaacttgtcaaaattgagcgaagtgggaggctttatagccaacaccaactccatgcaaatgggaaaaactgttattggttcatcgttgaagccttaggtatttgaagctgaattgggcgctgaagagaaagtgtagaagctagggctggcgggcaccaaagaagaaagtgttgaagaaagaaaagggattctaaatataacgttataggattttccaattttacccccataaaaagcataaaacgacacttaaaaaggggttaaaaatctggaaacaatggaacagattcaatgtaatgcaattagtataaacaataaagaaaaagaagtttaacactatctggaaatgcaagaaagcttcaagagaaaagagaaagtatttgaagaaaaaatcttggcctgtccaactaggttaatcttctattgaaaaccgacttgtcaaaattgagcgaagtgggagatttatagccaacaccgactccatgcaagtgggaaaaactgttattagttcatcgttgaacccttaggtatttgaagctgaattgggcgctgaagagaacatgtagaaattagggctggctgggcacaaaagaagaaagtgttgaagaaagaaaagggattctaaatttaacgtgataggatttcccaattttacccacataaaaagcataaaacgacacttaaaaagggggtaaaaatctggaaacaatggaacagattcaatgtaatgcaattagtataaacaataaagaaaaagaagtttaacactcatgaatctggaaatgcaagaaagcttcaagagaaaagagagtatttgaagaaatttttttagcctgtccaactaggttaatcttctattgaaaaccaacttgtcaaaattgagtgaagtgggagactttatagccaacatcgactccatgcaattgggaaaaactgttattggttcatcgttgaagccttagttatttgaagctgaattggatgctgaagagaaaactagggctggctgggcaccaaagaagaaagtgttgaagaaagaaaagggattctaaatataatgttataggatttccaattttacccccataaaaagcattaaacgacacttaaaaagggggtaaaaattctcttcttgcccgtaacactgggagcgactgcacacagttgtgaagggcatgatttgtgctctgattagtgcagcaatgactgcaactagaagatgtgatacaatagcttcacaaggagcgggacctacccgtgacattgtgatggtgcaatcatgccacaaatgctcgctattgactattctgtgatagacacgtgttatgtgctgcctagtatagatagaaaggtgctgtggaccagagatcagggtgtgtggatgctctggtgacaatgaccctttgttctctaactctgtcggtaaccgtggtgaggtgataggaggtgaaacacaccctagatctatagatttagtatgaccagttgccaaggagagagaaaaaggggtggctgaattttttgttgttgcaaatatatagtaattaatgagagagaaaattatgaagagccccaaaagttaatgttcatgaaaaggaaataaagatattattggtcttacaaacatccttttacaaatttctgttgttaacaatatattttaggttattttaaatgttgatcatgaatcaaaggtttgtgatatgttttgattcatgattcccagataggtcttttgattcacaatttgatgaccagtacctcgaggcaattgtcgttctatcctaaattgtctttcaaaatgtctaagccttattgaaattgtgataaactaggtaattttttgtggtttttcacctattctccgaccatcttttctctctgctaatctgcccccatcttttctcctccagtattgttaatagttagttgatggggagacatgtttgtgggcttgtattgtaaactttgttgtatttccatcattgcataattaatatctaactaataaattcttcagtgtattaggcttgatttgaactttttatctctctaaatttttttctcatttggtttagtttaaatggccgctattcaccataacattctctgtttaagtttagttttatattcaattttgcatatatttgttttccagaatgtaatcagcctaaaatgttgacaacattaatgcaatatatgagtaacacttcctatgctgttattccttgcattgagttataacatttgatttggctaattgaaactaactagtaatcaatagtttcttttttttactattggcaatactattttctccaatatttcttcctttttacccttgataatgaagtgagtgctgtgggcttccttttcagagcaatgtgagaaggataaggagcgtgttctggttcattgcatgtcaggaaagagtaggtaagatattgctgcaagcgtgcaacatgctatcataagcatgacggttacatttgaattagttagtgatatgaccctcagaaaataaaagggaattgatataggttattgtactgcagcctttcaaatgaggaatgcaatatacaaatgctataattttctctgaataacatgtatcccatggcaggtctccagctattgtgattgcatacttgatgaagtccaaaggatggagacttgcacagagttatcagtgggtaaaggaacggagaccttctgttgaattaactcaaggtatgtttgtttactgtttccatttttgcttccagtctccagtaaagccatcagattgcagtgttggtcaattgaagactcttatctggccaagttatttgtttgaagaccattatagaaacttcatcaaactaaaaggaaaacatttgcacttccaatctgtccacttgtttgaccatctattcgctattgtttttcctttgttaagccctgtgttttctggtgatccactaatgcctgtttgttggttgggtttcaacaaaactctttctttgtgcccttgtctgtcgtaggactgattcatgcacacatcagtaatttttctttttctttttttttttttttgctgtcatgtacagcacttcacaggtcacaggctcacagctcactaaatttgattgcatatgttcttattgttctattttgttttttctattaattttcatcacctttgtttctttcccttattgttcccttatacttgacttctgtcattacattatgctttagataaatggtgtctggactctggactcgtcattttttactattaatggctattctgctatctgttttcccactacgttgttttttggggtcatacaggattgacaactatgtttttttgaggtcatacaggattgacaactatgttttcacatgcatgtttacaccatgactgtttcttcaaaatgaagcaaccattttcatacagtaatagaataccaaggtttttaccctttggtaataaacaaaccatcctgttggaattgacacttatgtatgttttttctatatcaagtagtgaataatttcagggtttgggtgcctttcacgaggctaattatcatctttctaacatccatgcttccactcttaatataggtgtgtaccagcaactgcaggagtttgagcaaaagatctatggcccgatcgatagtggaagctctctgctgcctggtttctcgcctacagcacctccttcaattagctttggttttccaaagatcaatgatccagctcaacttccttccttcagcactgctggaactccttcaatcttcgcgcgagcacctctagaaattgctcctaccgagtttacattcggcgccggtcagacccagaagaatgtggctggaaatccctttaatgcaaatccagcaaatccaaatggcactgatatccaaatggatggttcttgattcttcaccagccacttgtgtgattaagctgcttgacaatttggcttgtggtaaagtttgcaaggtaccaccaggctgccatatttcaagtcaaggtgcagtaatcataagtgacttgtcaattctacaccaacttcttttttccccatgtttttctcaaatcttttcatagttatctctggttgtactattgagatacagcatatatttactggactcagtagatcagcgcgacaatatccagtttttaatattagaattaaaatcttatttacaagttatacaaatagtaaacaatccagctgtggaaccgctgttttgaaatatagaaaaattcatggataagtttttgaaattcatcatcagttttccacctttatttttttatcaccgtaccaaactaaccataagatgcttattatttgagactgaatgtaattttctgatcttgcgttttgtcccattacgtaagcatattaagttattcacgtggaaccgtcaacatttcaccacttatgcctcagtcatctcaccatcaacattaacattattttgtactctatcattcactttatgcttaatcaggcccagctcaataatatatggtgcattaaagtcatgttctacatttatggctgagttccatgcaaaagccttgtcaattcatttaatagtacttggcaatcaccatttttccgtggtttctctcctctcctcttatctcaaaagcatgaacaagttcctgtatctgttctatatttcttgccgtttcggtctttactgttcaagtgtctacatagcatttcaaattagaccaaattgaagtgtgttttctttctcctgcaatactaaaattgcatttctatgttttctgtaaagggaggatgagccttgatacaatgctcaagtgtttgtctgattttacgatggaaacttctaaatgatcattgaataaaaagtttttaattcttccttatgaatatgaaatatgcatgagaatatttgtctgttctaatgttaaattatatacatccaaagttgccatctcatgatttgaatgtcatatgtttaaatctgggaaataaccttcctgtttataagaataaggttggtaagcttccgattcataagaaacaacccaagtcgatagttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttatgattattgataaataaaaaaagttgtatggaatcttcgttgctcttatcgtttttataaaattgtgaagatataaaataaaaatataactccttatcaaacaagtccattaaaataaacttgtttttcctatcatttttttagttggaggctaatatatgcttgtcaaggttgcctctctccacaataagtctttcaaatatgagcataggagaaaacatttactaagggagtgggggacccgtgcatataaatagtcttgtatctaagtagctacttatagtataggaaaatctagtgtgattaaatatgaaaaagagtgagattattaaaacagttttattatttgtacagtacattacgtgttgcatatttttttctgattaaggtagaataatttcatgtcagttcaacacgtttgatgttttttttttattataaaataaatgatacatatataagtcatataagtgcacaaggagtgctggaatacataaaggactagataactccagtacgaggtaacaaagccaccaccaaaaaataaacactaactgactgccacataagaaaaaatcctgacgctaactatgccattatcatctttgcatatgcatattgaatatgccaatatgaatcccatagtactgtctactctgcagtggcagagtcaaggccagatcaaaacaatcatcatggcattacctaaagatatattttttaaaaaaatttatttttttctaataattatatatatttatataattaattaaaattaaaaataaaatttaacactatctcaaaataaaatttgacactacttaaaatttcacattacctaaaaataaaacttaactcggtcactctgaacctcaatttgcatatttgcccacccacccggcaaatatagtaagaaaacctgcaagtgagatgtgccctcctcttggctattgcaaaaagtgcaatttgcatcagccaaggttctcaaaaagattctgttttgtctgcacttaccctgcataattctccagactaaaccctgtatcttagaaggaaccggagtgctccatattaattaactaagaagcttttcctcctcccaaacacgttgcatataaatagtcttatagctataatatatcccaaaattaaaggaacaacttttcttgttttatttctgttgtccttaataaaaacccttcgagaactcatgcgggtttccccaacacaatcttgttggttgctgttatcttaataattccacatatattcactttctcccttcccaaataaactataaatagtataaatgatataaagtacaattgaagattagatgcgttcacgcatttgtaattgttggatgaagctcaattgatacatattttaatctgataaatcaaatttaaaacacacatttgagatcttaactatccgattttaatccaatggttacaaagcatttgactccgtaaatgcgtgtaatttctgagtgcatgcaggctatccagatcaatgaattaatacatcgttatttctcatcattgaatgtgcattcacgtacaatgctacagcaattgacaacagcatagaaagcttttaacctgcattgcagtggcctataattgcaaagctggtgaagtaatatttaaagtggattgctatatagctgttcacctagctagctataaatccatgccaaccgaaaaggaaacaacattttcaaatcgcaatagtatttttattttctggatcctacatacatttaaccaaccaagaccataaagaagaataaaattaagctaaaccaaccaaaatgaattcctcatatcccacaaagaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaactggactctagacttggcaacaacttgaaaacaaattcttattctagctagcatgttttgaaattcgttgggaaacgaaggaatcacatttaggacattgaagctataactgacagcttctgaaaatcacatccaaaacgtgaaaaatcacatctgagatgcgaaaccaaacacgctagaatcacatcaatgccccaagacattgacattgttgtgtgcaacatttggagagtcatcaccatcatcatgatggaaatgagaagcaaccttcctcacttcccccttgaaagtgtcatcaatatcaccatacaatccaagagagtcatcttcatccgtgcattcttccactcctccttctgggtggctggatccgcacccttcactcggatcttcgcgcttcacggcatgaatggtcggaccatcgtcatcgttgccgctggcctcggtgcccttcatgcaccacatgctaacaatgagaactccaagaccaaaaacgagcatgcctttgctatatttggccattgctagcacaagatattggtttagttagtttagtctttgagcgagtgataaacaaagttaggtagaaaagagaacgtggggtaatttaaagggaatgttgtttactattatgggagcaatatttaaggttgtggtttagactttagagttggaactgatcttaaggtagatccacttgaagctggaaacatgttatgttgtgcgtagtacaaggttctaactacacacgtggaaagtgaagatcggctatttttaggttgaaacttacgtgtaatgatggttaacgttgtaaaagttgcaacaatatgcacaagaagttgcaccgaactaaagatgtgtcactgtgcatgttgagccacttgtatacttttaagttcaacgtacgtgtttgggaaaatttatttatatgaaaaataatgttttatttcggaagtttgtttagagaattgatacgcattgaggtagtaaatattttcgtaaaagttgaatcttcatgttaatgttatcaattgcttacattctctaaaaaaacaaaaatggaatgtacatgtgtgtgattagattaatattacatctatctttttttctctctctctctcgtcattctcttcttccgagcgtgtatgtatatcccattggagggtgaaaaaattacttttgtcataaaaaacaatgctaatatattatcgccattggtgaatatatactattattgtgatacgaagcttttatattgatccaaattaattaaaatgcaacagaatggttttcattaattatataatgtgtaaaatgcattcacctcatttaatttttattttaatagaataacaaacggtgccagagattttgtccttgcacccgacctctatagtacttagatataaatactacctaggttccacctttccagcatcaattttactcaaaatttggtcaaatttgaatcccattccataaacatatagcagctaagtgagctaactgaaaatcatgacgaattgagtcgctgaccccatctcatttatttatttgttattattaattacttgtagaacctatttagatgttagtttctctagaaatatttttagaaaataaaaataagaagaaaaaatgaaataaacttttctataagctaaaataagtattttattagctaatttatagattccatctcatcttttagagaagctacaatggtgagcttttacaaattagctaatgaagagcttatttttacttatgaagaagttcatttcattttttttgttcttattttctttttctaaaaatgtttctaaagaaacttagttaaataggtccgtagtatagttaagttaggatagaatagaagaatagtgacttggtagaaagttgaactttgtctagagattgtaccgggctgtctgcccaacgtttagtattttctgttgggcctttggccctcgtttacgcctccaaaaaaagggaaattttattgatttatgtttcatttggacccaaaagtttttcaatgccacttatattgtacatataactaatttaattagaagagaccagggggttggtttgtttaatacttaatacttactacttagtaggtagaagctactgcacatatttaataatttttcatatccatggtggtatctatctgatagttgtaggaggcagttggtatctatctgatagttgacaccaaagtagctacccagtgtgaactgagccatggtggccacacccagctggctggggtcttccatcaaactcatgattttgttgcacctattctgctttaatgttgccagttagaattcaatataatgtaatggcttctctaacatggctttgcacaacgtttacaatttagaagatgaacccatatatagctatatttatgttctcccctgccatcctcaactacaccttacccaatatcacactgtgtgtcttcattttgacaaattttccttggcacatcttgcttttcttatgaagtattttatttttataaatcatagtaattaaagtccttgactctctagtaggacctcaaatatctcaacaaacttcgtttcattagattagttatgaaactaatttttgattcagaacttaattatatttaaaattcattgttttttttttccaaaaatttattatgaaattcgctcttgccattctcatttaattccaaaatcatctctaatgaaaagatcattaatttaaataccaatataaaaaatcttaaatccgacagaaaggaaatttcatttaaaattttaggtaaaatccttaaatttttatccaagtaagaataaaaaaattgcaacatatagactattggtattattttttttttcttttgcagccataatggtaggatgatatcagtattttttttatttgtaggaatcaaaaataaatattgaaaaatttaaaataatttatatatgacgtttaagcagcttatttagattccttatgtgatgacattgctgtgattttgtgattgcaatatctaacttataaacgagcgaacaaagcatttaattagaatcagtgacattggcaattttgacctctgattttaagtccaatttttatatatccatgcatctattttaattacaagtaaacaaataatttaactactatgaacaaaataaacatgatagtgattgggcgcatatcacactcactctattatcatataaaatttaactatattgacacgaccaaattttaattttgccggtgaactgtctcgaaagtctgaattatgaaaggaattccctgcaaacaccaggggcgtgtatcgtgtatgagtagactaatacctgcaaattacaatccccaaaattgaaatcgaaatcggacttctaatataaattaaaatggcgatcatgtcaagatcgataaaacctagacaagacactaaatgtgtgtttgattgtgaagaaatagaaaaaattggaaagaaatttttaaaaaattatgtgtggattaatttcacatctctctaatataatttaaatatttcttaattttcttctgctctttactctttcacacaatcaaacttatcctaacggactgtttgacaggaagaagatcataagatggataaaaataataggaaatagaaaaataagatgannnnnnnnnnnnnnnnnnnnnnnnnnnnnnnnnnnnnnnnnnnnnnnnnnnnnnntaattgatttttcattcaaaaagtagtttgttatttctgcggacacacacatgtaactatccacaaattttataagtatccatatgggtattcataaatatttgttaaaaataaattttaaatagtgtaaaataaaaatattttgaaaaaataattagactaaaaataaataattttaaaacatatatttatactacaaataaattagagaaatttacttttgtatataagaacatttaagtaatttcaaaattgtgggatccgtaggtacaagtaccttactgtttttaagattatgctagccctcatcagttcatttatcctccttcttgtattgttgagatactgaaataatatgagcattctttcgtcaaaaaagaagaagtaccttactatatttcctcgccccactaataagcaggtattcattaatgtatccatttttaactcgtagtaggttttactcacagatatatacgggtgcatgtttctaatttttgccatctctaccttctctattgcaatctatatactacatgtgcaaaatctaataatgtggttgctcacattatttggaatgaatttgataatatagaaattatcatatctattaaataatatgtaacatatcatcatcctttaaaaaaatgacaacatatcattaaattataataaagagtatttttttaatatatatcaaaacataatatcaaatactcttttggatccctattataaggtttaattaaataattcattattttttaaggaaattattattattattattattattttcaaatattacaagaaattgtaaagattaactgatttttcacccaaaataatcaacaagttattggttgttgagtggtacaagtttggcatccttaagtataaagtctcaagtttaaatattgtggatgaaaaaaatatgatgaagatagaagatcacactaaatgtaataagacaggttttgtagcgaaaatttatcatcaataaaatttgtgaacatttcataccaattaatgtcatggtgataaaaaaaattcaaaaacatgttaattgtttttttagaatgtcttagtaaactttactgtatatcttgtttttcacagtttaaatttctatctatccaaatagatacattcagtattcagtatttcactattttaaacagagctgtattttataaattaggagttgttaggaggaatcacataatgaatatctacttttgccggagagacaacatctctttggacaatccaatttgtatttaattttatgtaaaatataattaattgatatattgagatacaacatctctttggacaatccaatttgtatttaattttatgtaaaatataattaattgatatattgagataataatggatgtaatcttccaccaaatttataatttttctccattttgtaagataactttctgtcaatttatatctcactccattaagtattgtttaattacatttttctatgtaagtttatgtctacatctatttctctttgtgtcgaattcttgataacaaactcttattcttatgagaacattcagggtttgtctcattatctttatattctgatttatttttagtttttattttcttcattttttctctcctttcaatttttttaatcttattttcttttcttttcctttttattttcaactttttcgtatctataattgagttcatctattatagatctcaattaatttgtgttaaagacgatgttgatgatgataattaattgacacatgttgttcatcttacacagaatgtgataccactatggaaggaattagagtattacaaggagtatcaagcgaaattgagagcccatgttggttaagaaaaagccaatgagatcataagcgaagcgttgtacttgatgagcttgggaaccaacgatttcctaggcctcgaaaactattatgtattcccaacccgaagacttcacttcactgtgtcacaatatgaggactttctattgcgtattgcggagaatgtcgttagggaattgtacgcacttggagtttggaaattatccataactggtcttgtaattcccatagggtgtctccccttagagagggccacgaacatcttaggcgaccatggttgcaacgaggaatacaacaacgtggctatgagcttcaataagaagttggagaaagtgataacgaagcttaatagggagcttccacaattgaaggcgttgtcatcaaatgcatattccatcgtcagtgatatcattacaaaaccttccacatatgctacgtaggctatctaatttatttgctctaacttttgttgttcttttaacttctatatgcactatatatcttcaaggttttaaatattggttacagtcatattaaggtttcttcatatttattgatattgtgatacattacgaacaaatataacttatgcgattcaaattactatcgtggacagttaaaacaatcttaatattgtagcccaattaatcacgattgcaaactgtattttctttttaattattttttttattgcgtagtagattttaaattaatgaaatttgcgcatcatacatgtgatgtgctttaacttccgtatctaacctgtgggaataatattataaagtactgcagttaattgcataattaatgcatgtaccaaacaacggggtgcccttctcctgattgaaatcaaaacggtatgcttgctgcagatgttctccttcttcaaactccgtttcttttttttaaggcaaaatatatattaatagatagaaaatgtacatcaacctgtataagttgtacagtatgaactctacataccaaaagatatccccatatacagacccaacaaaccaatcatcaaactcttctccactattatccagacaaaagaaaaggtataggctaactacaaaaaactgatagacactgtatggggctgttgcacccagaagagaaaaacaagcctggtttgtttcccttgaaactttgttttgactctcttcaaacaaaactaaaaacttgtttttgtagttttaatataatatatatttttaatgatttattattattatttatttgattactaactttaagatactaactaatactacttatcttctcttcaaaaaaactaacacttatcttgatattatttaaaggacctgatatgtaacaatagatggttttaaaggtgatatttaatacatttaattaattgatttaaactatttaaaacagtactattacttatattgatactaatatacatacgccttattaatttgggaaattgaactttatgctggtacaattttcagattattattattattattattattattattattgttattattattattatatatactattaattagatatatcacactaacaaataaattgatatttttttttgaaagatcaaacatgttattaaaaatttaaaataaagtgtaatattaaaggaggtaaaaattataatttattaaagcatatattgagagtaaaagtcaaaaagcaatagtaataaactataagttaataagctgcttcatctaaaaaatattataaattaacgagataagttcatctattaaacacttctattatggtcaaagaaacttataaattggtaataaaaaaaattacaaagtacacaggcatcttgaaggatagccaacagaaatagggttgttgttttttagttcgtatgcattcaattaggaaatacaagaaatgttatgcatgaagaggacagctgaaacataacatttaatttccgataaaggtttggttcaattgataaagaaaagatcgatccatgatccataactcataaacatgaaattttattgttgatgtagaaactttattagtaaataatacataagtatttctaaaatcattctttgaaacttgagactttttataactctaatgagttctagctaggactcatttaattacctaaaattttgttaaatagaaaaagaaaaaaaaaacataacatttagttctaaattaatttgtatggccaccgaagctcgcgtgtagtacacaacttttaggtttgcttttacttcttatcataaatactaatttatgaaggtagagaaaagctccaacacacaaaggttcagtgtggtacatcaaccaaccagaataggtggattctcattctttatggatctcattgcatttccaaattcaaatttatgattaataaatcatcaagacataattttattatgtgtcaagactcatcctcatatatatatatatatatatatatatatatatatatataaactctttattgactaataaaaaaacatcaaccaaccaaaatggtagttaattttgtatccagagttcacacaagatttattaacaaagttatgcaagcatatattttgttttcaagagaaaataaaatatgcattgacaatataaaatattgttgctcgttcagtttatatgaatttcttgatttattaccacaaaaacctacataaaatattgaccttgatatggatattattaatttcaggatttgaggttgtagctagagaaggcgtgttgttcgacgggaacatttgaaatgagctacttgtgcagtgacaagaatccacttacatgcacagacgccgaaaagtacgtgatttgggatgcctttcatcctacggagaagacaaaccgcattgtctcaaaattatttgattccaaagcttttagcaacctttagatgatgatgatgatccattattttccatttaaaagattacatagtcttgcctagggcgacatcaaaatatacatatagcgagatttaatgtcgggttgccatgcttgatttgtatacttttttgtgtgttcaattgttataacaaataaattaacacctgatcatcatgtagtcatgtacaccatatttgacctttgtaccttctcatgttatactgtccttgggtttttgcttcgctgattcttgtatggctttgccaacttttgatgtttggcttttttcttttttatatacgcggactgtaatgttgtattttattaattgattgttcaattaatttaattaaattatatataagagaaatttaatttaagtacttgaatgaattagttaataaatttggtgatttgatttcatgtatatatatggttaatgagtttttagcgttttggacttaagataatgaatttttattatgtttagagagacgagtatgtatagtaagactttggtgtgaaaataaaaaattacaagaatcataaactctcctttaattctcaaaaatttgaaataaacacaaaaattctcattctactctcttctttctctccaataaaactcattcctttaagagttgagaacttgattgtcttactcaaatgatgtatttttctcctctatttagtgttcattggttgcccttttgcgtgggaaacacctcactttcctattttatatttgattttcgattttcgattttccctagaacacttatggggattccatgaaaaaggcttagtttttggatttgaatatgactttgggtttgttttgagtatggataatgtccttgtagtttgaattgctaatggagttgaagaaagttttatccttggatccaaagttccgtccttacttctttttcttcatctcaaagcaagttcctttggttttatagataatggaagctttatcctttttctatggttaggttgcattggattgctttaaatgttgtttgagaattaaccatgtttaaaaatgaaggtttgagcttttgaggtttgaaattgaggtttttcatttttcaatgaatattgatgaaaagttcatatttgtaaagagttttaatgttgtttatgtattagaattgatataaaaatgtttgttttagaaagatttgaaaatcataagagacaatgcaacaaaatttcaaaattttgcaaaattcgcatctactgatcaatttcgtgtccactgaccaattttgagtttaatgaccaatttcgcatccaatgaccatttttaagtccaatatatagttttgagtccaatgacttgttttgagtccaataactaattttcagtccagtgaccagttttgagttcagtgactaattttaaatccaatgaccatttttaagtgcagtaactaattttgaggtcaatgatcaattttgagtccaatgaccagttttgaagtggatgtgattaatgtttgtttttcttgtgtaaattaattattttgagatcttaatgaatttatgatgatatgagatatggttgagatgatgttgttttattattagagttgactttatgttgagatcatgagatttacattcatatgagtttttggtgagttatatgcaagaattcaaggtgttgacatgtcttgttatgcttattgaactatatatggggttcacgagtatgatgaacatataaatggtgaatttgtgatattataacctcttatggtgttgagattggtgaatgaatttgtgattacgtatgatattgacttgaatgatcataacatgcttgcattgatgaatgacattacatgtaagtaggcacataagttgggggtgctaagagggcccttaacctcgtgttggaggttgtcgtggtggctgacatcgaatgagcatgtagaatggatgagtaagcaatccctaaataggttaaggtctttgcaagttttgctgaggtaaaccactacctatgctcattcattttcgataaaatcagacttcctcctcaagattaattcaattttccccgaatggtcagatcatagagtgcgactctgttaagggatgtacttggattaatcgctcaaaaggtgaaatcttccaggagtaaagagtcagcatgatataacatgataagtagtcatgtgcactgataattgtgtctgaagaatgacgtgttacttgaatagatgtattagtacatggttgttggaaaaacgaaggatttctgcatacctttaacatgatcttatatttctcttatatgttgttttcttttaaaatgagtttatctttacattttctattgaactataatgatacacaagagcatattatgatataacttctgagaaacatgttactcgtggttgatatggacttagggacgagatccaacccttggtctttttgttatgttttgtcttagtgaaaatcaacttaggatttatatatatatatatatatatatatatatatatatgttgtatttattcccttaatgagacctttgagatttgtttataatattttgatgatgtaatgccttgggacacaatacttttatgttttatgaattgaggatctttttatggatgaaatttatgacatgcttgtatttatgaaaaatattatacgtattaattaaattaattcgagaattttaaagggagcatgtaataacatttgaagtcgttacatggataatataattagtgggaagtaattaagaaaaaactaattagaaagaactttacaaagaaagtagtaataagttttatgattttattactattgtttaataaatgtaatttgagttgatttgtttataaaatgttgaataatttaccttttgagcattaaattataacaaattttatgagaatgtacgcaatataacatttgataatataagtttctgtttttttatgggcaaattaattatactacgagagtagaagggggtattacaatcttaatataaaagaacttatccagaaaagggaaaaccagggtgaacctaacatattagggatatttgtacactaacgagagaaaaaatgttacccaatttaccaaaaaaatcatgaccatatgatctgacctatattaattagatccaaaagcgtaaaaatgttgaaggcaaccaaagagttcaaataactgcatgttgtatttgtcaagctttgttttgcacttcttcctaaaaacaatctaaagaatttacaccccaatcaggggaaaaaagtgtctcacccaatatagtgatgtacaagaaaaccaagaccaagatctaattaaccactattagatccaaaagccaaagaatggaatcatgcctaaaaatgatagcgtatgggaaatatatagtattcataaatatttgaagaaagtgtaaccttaattaattaacgctcgaccatgagaatacagcagacaaaacttcatgaaacaaagtacatgttagcatgatgagattgatgtgtaatacttcactatgaaaggcaaaaaaacataaaacgatcgatcctgctagacaaccataacattccttttgagtaaattacttctggttagaatttgattccaaataatttgccaagagaaagctaagactctagagaaggggcatagcattccaaaactttctaaataaggtcaactcagaattagaaaaaaaagttgaataagtatgaaaagctatttcgcaaccacatatgtgcatatttagatgaaaaattcccacagatttccaaagaccacacccacatgtcatacttatccctagctaggaccgcatacctcaatatgtcaagcaatgcagacatcaagatttcctcctaaaagaatagagacctcctccaactaaacaaccaaacccaatattcaacaaaccacacctcccaaaatccttgaacttgattaccctgcacctaaaagtggaaatacgatacaatctagggaatagatcttcgaagctatcatttcccaatcaaatatcttcttagaatctaacatatataggtaccacaaccagtccttttccaaacaagaggaaaaccaaccaaaagaaatttcatgactgttcagcttggatatatacatatatcccaccatcaaagggaggaatattcacaattaaaacttctgacaaaatttgtcaaactggcattaaaatgacccatacctagaacaaagaatatttatctaaaaaaccatctgattcagacagcaaccaccaccgccattttgctaagtggtgtaactttaaccattccttggacttaaaaatcactttccaactaactcaagcaaactttcttttatcttcaatagtcactaccaccaaaaatcgagtcaaaatatttaaaaccttccttggcatggtagtagaagttacaggctactcaacacagaattcataaaacttaatatagctacctcaaaagagagacgtttacttttccaagatcccaacttctaccccaaattaagaatgaatatcaggcttccaatttgctaaagtcttaggattagcaccaattgaaaggcctagatacttactttaaaggagtactactacctaaccatcatcctcattcatatgcaattaaactacttttatataaagttaattttaaggatataaagctggctcaaagcacctcaaaaatagaaatctacctgagacatttatatgtaatttccctttaacatctcagtagtcatacatagggttacattacttttgagtaaaaaagtttgatccacgtgatggaaatggcagtagggatagtgcgcaccccagacaagacccatttaatatttcgcagccccaaagttcaaaacaggtacaattacaacttaactcttggtttgaggcccaattaggaaaatgcaatttttttgcttcctgcacccccccaaaaatacccagtcaaacaaaaataccctcatcaggcacccctgcctctcccaagcaaatcctagccatcaaacctccataatcaccgcatcccacctccaaccaagtgaccaaccacccaatagtatactaccgccgcaccctaacaccaccactacaaccacccaacaccaccacacccaccttcacccaacacgaccgccaatcccaactccttctacaagaccaacccaagatgtattgtcaaagttagcattgtcgacgttgcaatgaagaaggaaccaagtagcactggcccttctttgttcacacttctaatgttgtgtccttctgacctttcaccctaataggtttgctacactctgaaccctcataattggcctcaaacatggctcgctaaccaatattttgtcaccctattctgaaataggtttctggattacacactttcaaaatgaccattctcttataaaagaagggtaatgtgggaattttaaaacatttgggatacaagaagcaattgcgggcaaaaagtagctattagccgtacaaaaatgtagcaacataaacataatttattataagaagaaaataaattatatcggtataactttgacaactataatactattatataattttcaactgaataatattttcttaaaatttatcatttgattgaaagtttatttcatataaatcatatattcaaaatttcatattaatccaaaatcatttgatacctcgttcatataaattaaaatcgacgtaatataaacatttcaaaatatactaaatatggatcatttgattaccttcttattattttttaattttgacaaaaaaatgatcttaataatatgtcgatataattcaatgattgaatcaataaaaattatattatatatcaagttataacaatagtataatagttgtcaaaattatattaatgtagtttcatctctcttcatttattatataataatgtaaaaaatatttgctctattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgagtgacttatttatctcttttttttttcaaatgttaaattaattttgaggtgcttatactgtttggcgattttgaaaattctgaatattttaaaaatttgtgattgaatgtcagaatatttttaacgtgcatgttatcgaaaaaaaaaaaaaaagagaattgtttaaggtgctctaactcttaattttccaaaaaaaattcccgcgattaactcttttgatttccaatagtatgctaccaatgcaaagcaattcggaatcttgtacaagatatattaaacattttacagaaagctatttgaaagagacatgagccaatacaagaacccaccctttaccaactaaccatataatctttttcatcaaaacaactatatatatataacacaagtatttaagcgagttctcatttgaaagttctgcataatcccccaaaagaaaaagcacattactcctttaatatttgagtcctataaaagttagtccactaaatttaaaaatgtgtaaaataatatacttaatatttatgaacaatataaaataaaccttccattgcagaaattattaaataatagttaatagataaaaaaatacctttacatatgtaaaggtgtatattcttccacctgttcttttaactttggttcctgcaatagtaagtaaatgcttcacatgcaatcataaataagtttgctttttttataagttaacgagaatttcatcataaatccttagtcaataactcactgctaataaaaatttagaagaatagagagataagttgtaatgtcaagtaaaagtacattatattttgtaataatgtggattaaaaacaaaaattattatatttaccagtcctgaaagattaaaaataaaattccttatatttacatggcccctcaatcatataaatttaaagagagaaaataaaaaacaatgtattctaatggctcaaaagtcaacagcaatccccgaagtgtccctatttttgtcttctaaaaggctaaaacaaagctatagtttagaattatgacaacggtaaacatatatagcaccttctattagtaaggtagggtccgtactgtttggccattcaagtaaaaatataatgtgagatttgaactatatgttaataaactagtgcatctaccagacaattattcatacgatacgtactggtttacaaattgaggatgcttgattcagatccctgatccctctatggagattaatgttttcagcttaataagaatcattacttacaatcattatttaggatagcatttttttgtgtgaatattaaagataaaatttaattaggatatttgatatcatgaagattttttgtatatgataatttaattgataattattatgtatgataaatttattagctaatttttataataattattttaaaaattatatttaagattatttttaattgattagcaatgaaaaaaaaatagatgacttttacagttatatataatactatatatgaaaattaaactcttaaataaaatcctaattttaccctgcaaattatcaaggacttctctctatcagtattatcgagaatcaaattatcgatagaaaaagtccactgtaaatcattgaaaattcaaatcattcctcattcttttctatatatctattttaccaccaatggccaaataactaacgagaaagtccactgtaaatgaaagtggcattgatgaaatcatgtgtaaatgcatcatgtaattgtttgtacatgtacacgtaatatattcatgaattaatttattaactgtggtcactcatgagaatatatatagttagctagagattgaggaaaagattgttatgcataattcctgcgtacgtactggtacctgagttatgcatgatttatgatacacactattagtggtttcttttgtgaaaagagagagaaaagtctcatttattgagcaatggatacataaatcgtgtcacctcctttctcgttgagtagcattgaattaatggaataggccaagagcagatcaggaactaacttgtcccttcagcggttgcaactacacatggctacctaattaataaggccgtcgcgtctctgtctctttctcttactattccagctctttcggtggtagttggtgctggaattagtcaaacctgcatttgtaatatggaatgtgagattccaacaatgtttattgtaatattgaattaaatcaagccattttttattatgagctggatttttcttggtctaacctagtccttgatgtgtcgtggactagtcaattttttaatatataaaaataaaaattatcaaaataaattaacttctatgtataaaagaagttaatgagatatatataattataaagagttcaagatcatttttaaaagagacaacaaggaaaaaaagtaattaaaacccaatctcatttacgttgggctcaagaaacttacaaggaatccacccatttttttcataaaaaaaaaaacttatacatagttataagtaattaaaacacatgttgagttattaattactttttaatttaaataatatccacaaattaataagcaacacgaatgaaaaatctataagatatttaaaaaatacaaaagtttaaaatttttctttgtcaagagagttatagaaaatataaggttgacttgataatagagataaaagaagaaagagataggtcataaattcaaatcctctactaataaaaattaataaattaaaaaaatataatatctaattacaaatagttgccgagttttctgatatatcatgaacttgaaattaacaagaaaaaactcttgtcacgtgaaagttttatagaaggatatgaaaatgtggtgattgcggtctcgtgcagctactaccagatatgtagttaaaagacatccaatcgaaaagaactgcttttactagatttagtcggtagatgatatatgcttcaaatttattaatatacgaatttggttgaatgtaattcatcaatatccacaagatcagttcatgcaatggaagcagtacaacttgaactcacgaacttatttatggttttgcacggtgagtcatatatatatgttcagctttacaccaattcagaatgaatctcctttgcaagaaggtactccctctttctgacaagctaggtgtgacacaatctagaaggatggccacaaagaagaaaaaatttaataaattttgatatatatgacaaataattcagtttaattctcttctccttggaccttgggggatagtttttgaagacattaactattatttcttgatttaggcaatgttttatcacgctaaatgttggacgttcgggaccataaaaatgtataatactcattgcgacatccataatattcttcttaaacgatctatgtagtactttgtattccaagaatgtttttcattacactaagatcttctatgacaaatatttgctcaatgttttgttgagaacaagtgacttcatttttagtatgagcatggactcaccatttttatagattttcacaaaagtagtggcttgcgaaagtcttctaaaagttatgttagaccataaaaagctcgaaatttttgtaccattattttagagcttgcttcatatatactataaaagttttactgcaaataacacactaaaggctcatggtctgatactatgaaaccttcaagttgctctatatataaagataaatatagtgtcttcattaaaattttgggataaatacttatatataatttacttgtgccccgatctagatcttcaaatattttagctctatcgatcatacttctctaacaaattgtgacatgtatattgtatgtaagtgaactctttgtaaattttgtacgtttggtggttatcctcgtgcatctagtttaggtagtacaattatcccctatccagcctccagcaggctggcacttgtgttctattctttgcggattttaagactttttcgtgtgaattgaacgtaagtcttgtacatggtgtcatgagagaaatataaatacattgtagggtctagcagaaatttgtaagatctcatttaatatgtttgtatttatttttccactcacatgaattcatcacgtaaaatcccctattataagatttaatttatgatatacattgcacaagtccatcttttctcaggggtcgacattcacatgacacgcgtcatatttaggattggttggtatttagcttttttttcttaatttatttgttaatgtctattattaaattatattgtgtattattttcgcctgtttttttatttttttgaagaatttactttctaaaaaaaatattctcaatttcttgtataaatttttaaatgaaaaaaaaagtaattttttgtttatcataaaaaatctagataaattgaatcttgataatttatcagaatcaaaataggtctcaagattcaataaatacttagacgatagttataaattatttatcaataaaatttttactgagaaaaatatattatttatcaactggaataacctttattgaaaaaatattttcttttatgttatacattcaaaaaaagaaatgtaaacaaccatttaccccactttgaatgctcgtcccatccatagaactgttatcttgtcttggcaattatggtttccaacaacttcttcacccaaacaccaaaagatcaaagttccattaatagtcctaaccaatatttattttctcacaagttcacttccctagcacactccaaattcaccctacaacaacgacacacacacccctcacacaataatggaagaagggcaaagaaaaacaacactacttctatgctcccacattgtggttcttcttttactctccctagtggccgagactagtgccaaggtttcagcggtgatcgtcttcggcgactcctccgtcgacgccggcaacaacaacttcatccccaccattgcacggagcaattttcagccatatgggcgtgactttgaaggtggaatagccactggaaggttttgcaatgggagaataccaacggattttatatcagagtcttttgggctgaaaccttatgtgccagcatacttggatcctaagtataatatttcagattttgcaagtggggtcacttttgcttctgcagcaactggttatgataatgcaacctcagatgtgctggtaattcatgtctttttcaagctatatatataatggaactatatatgcatgctttactttttcaataatatctctattttttttttcttggctgatatattgccagtcttactatttttgaaagaaaaaaaaattctatacactccattttccttaaaatgttagtcatatctttcatttttctttatatatatatatatatatatatatatatatgtatgtgtatgtatgtatcacataatatcatctttcatatttatgtttttttctctgtcagtaaaatgatctttagatctctatttagaaaataatattttttttgctttcaataaatgagcaaaacatagacacatatagttttttttaagagacatataaaattaattcaaattacttatttttttcccttgttttgcttcaaaggaaaaggaaaagaaagagagatagataaaaaaattaaaattaaaattaaaacataaagaaacttttagtctttttagagatcaactttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctatttttttttctcttctctcgtccaaatatttcacaattttttatgatgtcattttttatgaaacacctctctttaagatttgaattcaatcttattaattatatttatttcactcttttaagataagaatatatattttacatgataaaagtataattataattattaattaaataataataataataactaaatttatgactaaatacatataattaatgtaaattatttaaatttaagaatgaattctaataaaaagtaattttgagcaaaattaatctaaaaaaatgtcactttcaaaagaatatatttaaatttgatatacaaggctgtacatatgtagggttacatcacattattttttctaaatcatttcagctaatctccgcactgctacttcctctttgcctctcctctgtttctcttctcttctctgtcaaacaaataggaaaaactaaaatctcctctttatttttttcattatttttttttttgttaaaatctgaaatttaaaaatgaagcttatgagtccattgtccaagaataattatgcaaaccataatattggttgcagtctgtgataccactatggaagcaattagagtactacaagggataccaaaagaatttgagtgcatatcttggtgaaagcaaggcaaaggagaccatagctgaagcattacacctcatgagtcttggaacaaatgacttcctagagaactactacaccatgcctggtagagcatctcaatacacaccccaacagtaccaaatttttctggctggcatagctgagaacttcataaggagcctctatggtcttggtgctaggaagatttccctaggagggttacctcccatgggatgcttgccacttgaaagaaccacaaatattgttggtgggaatgactgtgttgccagatacaataacatagcattggagttcaatgataggctcaagaatttgaccattaagctaaaccaagagctccctggactcaaattggtgttttctaatccttattacattatgttgagtatcataaaaagacctcaactttatggtatgttatcctaaaccatgcatatatgtttttcagatatcattgtctctttcccccttttctcccccttttctgtttcagataatttggaccctcctcccaaataaaatattaaaaaaattcactattcccccttacaattttccactgtttcgttcttgattttatatattgtttctatctttagtaacaacaataataaaatcaataatatatagaataaattaaatatgcattgacaatctaaattttttatattgtcatctaattataaattatcatgtataataaatttgttgatttttaaataattatcttaaaatttatatcaacaatttctaattagttaatgtacccatctcttaatattttatataaatcaatcatgatgtgcactaatttattattttttttctcttcaggatttgaatcgacctcagtggcatgttgtgctactggaatgtttgagatgggttatgcatgcagcagaggccgaatgttcagttgcacagatgcttcaaaatatgtgttttgggactctttccatccaactgagatgacaaatagtatcgttgcaaagtacgtggtgctgcgtgttttatatcaattcttacaataaacaaataactactagtgaaattttatttatgtactggtatctcttcatgtttgcacattcgccataaagtgccattcgggctttctatgaatgactgcatgtcgatgtgtacatatataaaaatatcaatacagcacattcaccatataatgtgctgataattagaaataagtcgttttgtttagaacaatatatatagtatttatactttttaggcactttactagagtcggtgtcctccatgtatgttttccttcacatatatatgtcctattatgttgggtctatagtttgtaatatctatccatggtttggaaatgtcaaatcccaaaagggagaattttctgatttttctttggttgcaattatttatgggcaaaatcaaatacctacttcattgccaaattcacttttcagaaattatctaaacctaattaatcaatttaccataaatccactagagtcgaccaagtggtttgaagttgaaatagaatgaatgagatcataagttcaaatcttagtgcaactacaactatacaccaaaaaagtcaatttaacatgaacttattcaaattaataaattcatccaaactccgtttcacaaattagctgaatgataacaccatattaactctttattaatcattatcagtatcttaataattagacaccatttctagggcatctaccgcttttgaaatgtaaatgttctttaaaaaccaaaacggtacatgaacatttcctcaaagtcacaatcacttgtaaattgtaattgtcaagtttattatgatgtcatgaaacttctgacttttgagaaagtacattagtacaaccaacacctaactatgaaactaataaagccaatttttgcactttcataagtcagtcatattcatgcttgagcaaactgccaaaactagataattccaacatattgggaaaaatccaagtcccacattgactaaagataattttatttatgatatccttctcattgttcattgcaacttcagcgtcaacattagctgtttgtaagcatactgttgctagttcgaacctcagacactagtagctttacctcttgttgaccagatattatgatctgtagaagttttctccattggttttacatatcagatattgtaggcaaatatgatgttttagttccaaaaggatcactttggattccaatagtttactcttttgatgggctcttcctttcttcctcgcaacataaagaaaccatgtcttccaggcaaggtaccaagggaatctcctatttcagagttagttttacattctcatcaaggaataaagcactggcaccaaaatttaagagagctgatattaaaatttatcttaatccatcccagtagaggaatctatctaactaggcaaggagcatgttctagagttgagtctatacagaagacaaatacacaagttacttccatttggatgaagctccaaaattctaaacaccatctcctagttatgattctcattgttacagactttggagttcttgttttctctaaatcaaccaaactgtagagaggtcaactgagtagtctttccttgaaaaaagccatattatctagatgttatccagattatcctccagtgttgttctggttaaatcccaactgtctatacttccagcgcccccaaagtcctacaagcaatggacagtgttttcagaacagtgatgtaggacatgatgcagatgtagcaataccccaggtcattcattggtagcgctgcatgacaaaccagccagataaggtgttaacaaattttctggaattttaaagctccaaatccaactcaatataaaagtgcatagagttccatgtgtgtgcatgtgcaactgttgaaatttataataaaaatatggtatttcaaaattactgataaagtggtatgcatacagtttacaatcaggtttagaggcaaatgattgaaagggaaattcaataaaatagacctaagttgtttcaattattacaaatcttacaatagcaaaaagaacattttggcaagccttgaggcttaaaatagaagcatgttatatgaaacattctaatcaattaaaataacaaattaacaataagagattaataagtaaactaactattaaaaatatttaaaattataacatagaacatggccacagaagtaaaacaaaacgtaacatctatctcacccaaaaatatgaacagagcaacatagcatagaacataagccaaatttttttcaaggtaatgaggttttcaacaaaatcctaatcaaaagcattgattgcttgcaggataccatttgattaaagtcaagaaacgataaaaagaaatgcatgatagaaaaacaggataatacaatgtgtgaaaacatgggaggatctgagtagaagaagtaaactgaacaaaggtaaaaaatgaataccttaaatggagctattagttcttatctttatttgataacctttttaaacccttccagatggctggaccttgaggatgcacattcacaaagtactttacaaagcgtttatcattggatgcaattatggtactcagggttaatgtaggatttactgcattcctctcctttagccacgcatacattgaaagtctttcaacaattttgtccaaatcatggcaaaaatatgttgggaatcccacgagacattctagagggtaatctaaaacatttcttaagaaatcaatcttcttttgaattacagctttgttctggcttagaatcataggagctcgttttatcatttcaatcacactgttatagtccaaaccagcttctaccaggcaatcaaacctctcttgtaattgatcacctctccctcgaaacatttttaacgctttggccatctcttcagagttctctgtgtatcccaatttcagcaagaaagttgtcttttccaaataattacgtgggtcatgactatctacctttccattgcccttctgctcctgttttgatgccaaactaattagcttcaatggatcatcctttatgatttggcacaaatcagcttttccaacttttaactcctgacaaacagttttatgacctttaaaggaacgtgtaatcaggagatgcatgtacttagacaaaatatgtgtaatgtcatcttttcccattccaatagcacacaaaaagtctatcactctcaacatatctttcgcacacttattcaacaagatattgggatactctacaaaataagaataaatcacattcatctcaacaccaactttaagcaatctaccaaaaactaagtacactttcctcccaaaaccctccaacaacaacttaggattttccctaaacaaattgtgcatttgttcctcggaataacccactttatgaagaaacagcatggcatcaagcattcttttccaagtatatgtccttgaacaagacaagtaattcaccatccaatcactctcaatcccaattctcttcaaccaatcaagcacagcaacaaattcaaaattcacatcaccaaccaaaagcaaagggcaacaaacaacaagcttgacaacagttgatttactcaaacccaaattctcataagcttctaactttgacaacaccaccccactagcacacccaaaaatctcttttgcctctttaaaaaacttccccattcgattccttggcaccccatagttacacaaagcatgaaaattttcaagcagcacatgatcatccgccaggaaaaacatgccatgcggaagaaacaaatacaactcagaggggtcaattcccaaactctcgaaaaacggttcaaactcgttaatggggttgtacctgaggaatcttttcaacgatcgaagaacatcatctttgtcgtcaatcattgagaccaacgattcaataaaacgtggtgagttcttgctgatgtactcggcgtcggagaaagtgtagccccgcgtggaatgcatgtaatccattagagcgtgttgagcttcggacctcaagaggcgagagacacgtttgggggaacgtgacgagagaacggaacttaacggagaagaagagggaagagggatgggttcagaagcgcgaaagcatcgaactttgagagaaatggaagatgggtttttttgtgaaaggggttttggaagcatggcgtggtgggaaaaatagaagccatttaaattcaactgggaaatcatttgagagagataataaaagaatgaagaagactgcaagtgtatataagcatgaaatgaaattagggcgttcggtcaaattcggtttggtaggagtccaatgtaattttgtgttttaaaacaaattataaaatatatttttccttcatcctatttagtctcttttttttcttgtaactttttttttttagtttttataaatgtatttgttttttcatctataaaatgctttggataaagttttgagtgttttgatatctaaaccattttaaggataaaaaaacaaaataaacatatttagaatgtttaaaacaaaaaatactaaattataagaatgagaaaaatattataaaaaaatggcaatgcattgcatttcatcacagtgctccaggtttttgctaactcttcttaaaatattatgtccagttttgttcctaagaaaaaaactgcacacattgattttatgacattgccttctatacttcactgaatgttaccatgtaataagatgcttgaacacatcatacaaaatacttgaagcatgtgatgcagtgtgtccctcaaaagttaagaggacctaacttcaacattggcagaattgaagcttgaatcagaagatcatgatataggaaaggaaagatacaaggggataagaagcaatatcaattaattaagtacgtgttaagcatcggaatagaatgggaaagagaagcaaaagcttggaggtttcgtaatgagatgcaatgtcgtgaagttcatgtttggttgtagtttaaaatgtagcggcgcagtgttgaaaatgagatagtataatgttttattattcactactaactagtaatgtattgatgtattatgtataaaaaaaatgtattggagttcgtctggatgtagtttaaaagatgttttaatatcttatctattagaaaaatgtattttttattttttaagagtgtctagttattatttttttagcttttcttttgggaatgtgttctataaattatgcttaaataataatgtttttaaaaaatttcaaaatgataaacattccctccatattttctaaaccctcaatatgtaagttttggttcctctctcttctcctcataagttttgtgtcttcctcgtttctctgttccttaaactctcttttgtttttcgatttctcttcatatcatcttcttcatctcttcttcttcggttgttaacataataggttaacaatttcttcattaattcatttttcttctcgttaaattttgaattattatgtattagaattatgattttgtttgtctcattaattattatgaattttgacctcttgaacatattcttgtggagattgtgaggtgttccctaaatattcttgaatgtttatcattgtttctagttcttaaacttgtgaaatgtctctcaatcaagttcttgtgaaaagaaagaaagcagaatggtgtgataaaaatattaagattctgctgaaagtgtacatagaagagttgaatgctagaaataaacctcacaaccacttcactaagcttgattggacaaatattttataaaaatttaataaagcaacaaatttgacatataaatataaacaattcagaaaataggtgggattctttaaaaaaggaatgacaattatggactaaatttattgggaaggacattggtctggctgggatggagagaagaaaattattgttgcttgtaatgaatggtgggaagctaaaatttaggtgtatattgaatctatagttatttctttataaaattatttttttagcacctttagaaaatgataggtatgtcttaggaccttggaccaggcttgttgtttatcaactcccaaacttttggtattgaagccaattgtgcttcttctgtattttctctttaatgaattatgctataattttttatgatatacaatgcttctgaatttaataattggaaagcaatattgtatttcatcatacaacttacaattatacaacttcgggaaatttctaaatgcctttgccaattgcattgttataaataattatttgttagaagttgccagcatctcttggtataagtatttttctttgaaaaagaaaattcttgaacgactggtttgatgtaatttattgtggtcgtttatatttaatttgtaggtcttgctatgtaatgccttaaaagacattctttttttatcgggaaagataatatatttatatacataaataaaatgtagagacaaaaccagaggtacttacacagatacatcacccttgccagagatttcataaccccgtcccatctatgtgcatgagcaaatggaaatacaacacggttgcaatatattaatgatgctggaacattaatagaaaacaaccacatacaaatgttctattccagtacccacacgcacagataaaaaaatgcccaccaataaaaactctttgtttaaatactaaacactacttgctctagacataaatctttgcattattaatagatatttcatatttctagctatgccaacattgcagactgtgataagaagaacctgtcaccatgcaggaaaataaaaacgaaaacttcatcaccaattgaccttccacaagatctggtcttcattcataatcctccaaaatacaggtccctgtgttcgagtgccattgtgcaaaagaaacagagaagcctctttccaatccctttatccactgccatgagtgatacagtgcttgatagacaatttcctctaaatatgatattgttcctattgctttttggaatacactagtgacattttgtaaattttattctagccagaagcaatatacaaaagggtcaattctgaacttatttaaggcacatctattgctttttgggcttatcttgaaatgctgctccactaaccggcccgggttgggtcataaagagtcacgcaaaactaaaactaaaagtccatccagtccaaacgttcccatctcgccaccgtgaacacccccacacattaacacactccaaacgcacgttagcaacctccgccgtcttcgccaccgcgcgatcgccgtcgatggagtctctcttcgactcgatcaacgtccgcgaccttctttcggcgcaggacctttcggaccctaactcccctctctcggcgccggatctccgtctcctgatccagcgcctggagtcgcagtccctccagatccgctctcaggtgcagtcctacctcgtctcgcaccgcgacgatttcgcgcgcctcttctccctctgcaacgacgccgtttcacagacgcgcgaggtctccgacgacgtcgccgccatcctccgactcctatccgaccgcccgatcgacgccgaggtgcgccacgtcgtatcggagataaaggcgaagaaggaggaactgaaagtgaagaaggaactgctgggattggttggaaccgttgtggcgctgaaccagagattggacagtgtgagggaagcgttgaagagtgggaggttcgaattcgcggcgcaagggttgaaggagttgaaggtggcgttgaggattggtgaggagaatgatagggagcctttggtgtatggcttgttgaggaaggagtggtctcagtactttgacgaggtgatactctgctctcttgttgctgttttttatggtttcgtttggtgcattaggtttatagttatgtgttaatgcgtggtggatttggtgctgttaatgtatttgtgtgtgtgccaattgaattgaagcctttcagaatgtgaaactgaaataggttttggtatgtggtgatttcaattgcattgacaatctgagtatgaaaggaatggaaatcagggttgatgtatgacaatgtgcgataaacaaatagtcaaatacaagatttcatggctctgtgcattattgttctttccatatttcccccaaataaaggccacgtactcagttgtatggaaacaaaatgctagtatccctgtggttaccattggcctaggaattcatttatgaagtttgaattcagccaagtttatgttacttggactattgtcaactaaacataatgatgataataatagttatataatgatgtctatggtgatgatatactgtgtaggggacacttaacgcgtttttttggttgaattatattttcattgatatatttgacaatataatcaattcatgtgatttgtgccatggtactgatggttgtatagtttgtgatttttatagtttgtgattgtttttagaggaattcgatttgggtttgtagattcaagaggtcctcatgaagtttatggaaaaagcagtacgatttgatggggatttgaatcaagttgaagtcaagtatcatttagaagttgagaatgtgaatgggattcaattacaaacagttgtggaggcaatggatgtgagttaattcattatattttatgctctctatttggaacactctattctattcctcttgtgctgttgtaaggttagaaattgatgagctccgttgaatttatttgttcttcctctaatttatgtccttttttaggtagttggtattctagagtatgggcttgctaaagttgctgatttgatgatcaagtatgtcattactccttttgtaaatcatggacaacctctttcatttcttgaggaattgcatcaagaatcggctgtactgaagatagttccatcaccagatagtaaggtgagtatgatatgttagggtcatagaatcaattgtattgctcatgctttgccattttatgacagagacacccgcctgcacctttggcggggaagggtgttgcttgcttgtgttattgatttattcatgaacagagttctcaattttctagtttagatttttttaataaattaggaagcattgtcatttaactgctattttatttctaaatatctgattttcattttgcagtttgaacatttggatggagagtttctctattcagggattctgctgtttatcaaatttatttacagaagtatttgcttccagaaaagttcttggatgcggtgttttggacggttgacatggccaaggatatcagagctaataatatctagctttctttcaaaggtttgctcttcagccatatgccattagaaacttgattgaacgaagaccatatccatgcatcctgtgctttgaaacaactctaaggatgtgtatctataaaaataccatttcattgatttcaattgatattggatcgaatgctattgttgccttataatatgcaagtgcatatgaattctaccatccctaccaacaaaaataagattattccaaatcttgtctatcttatgatctagaacaattatttagtggttagttatagtgtctgaaagccagagaggaagtgttgtgcgtatttgataatttgcagatagtcacttgagatgtctgatttcaggttgtcccaacagatgcatcaaaacttactgactttcggaagatcattgtatgttcatctgaatttgaaacggctttaaaagagcttatgtacatttcagcatcagatgacaaagataacaggctgagcaattttgctgaaaatgttgaggttcactttgctttcaagaaaaagacagagatcttggctaaagctagaaacctgcttctagaatgtgatttttcaattcctcaagtgagtttccagactgggaaaactcttcttttgctattgtgatctgtaattatttatgaagaatgtcactgcaggagtatacgagggatggtgctgtttggaagagtgatgaaacatctgtccagtcatccagccatgtggtagatttgcttttcttatcagagaggtgtctagtatccaaagcagccaaacaattgatggagctagttcatcagacactgcaggtataccatccagaataatgaaaatattttactaatgactctatgcagcacattttatttgaaataaaactctggactatctaaatactgtttcaatcagtagatatatgctagtttttaccaggtctatcacgatcgagttatttcctatagaggtcattctcattacggcctgtaacaattgctgtacagctgataaattgaaagaaaagtatacaaaatgataaactccggctccccagttagttgtaactaacatgttttagaatagttagaagagggatctagaattggtcccactgaaagcacctgtaaattgtatatagttaagggtgatgatggaatattatcataacaattagatatcagccgaaagtctctaaccagatactttagtcagaggttcatagtattcttccagtagctcaaaactagggccccgctaacaatattattcacctcatatctattaacctgcaatgatgtcatctttcaatatagggattagacagttgatgacaaagtgtattctttgtttttcttttcttttactaatactgtaatgataattgtttgattattgaaccatattaatactcttaatttaattaacatccatttaagtattttcagtttattgacctacaagaattttaatattaatagtgaagctgatcattgcaaatgaaaatttgtccaggatgtttgcctgtcatctacaagagttgctttggaattttatcacacagctagagatgctatactactttatgaagtagttgtccctgtcaaggttagtccatgtaaagcagtggccctacttagtatttctatcattatggattgattttatggggtgaatttaatacagtaatgcaagagtatggtcaatatcattattaattctagaatgatgtcctttgtgctaatatttaatacctttcctgatctttggctgagattacctattaactactataaatgacatccaatacatatggaggatttatcttctttatgatgttgttaacttgttgcatatgtcaggttaccactgtatttgggtgttagttgttgtctgtgtatactttcagcttatagtaataacttctgtttttgatttgtgaagctagagaggcagctcaatggcattaatcaagtagccgttctgttgcataatgactgtctttatctctcccaggagattcttgggtttgcatttgaggtatacatacttgaataactgaggatgaagtaaattcacaatatttaaataatttactattctttaagttttaaccaaaaataagttttttttaaaaaaaaaattctgatgtcatccttaacacattttattttaatgttaggttgtttttgtagtatttgattaaaacattactggggcccattcctcaaatgaaaaagtcaaggaaaacattcaatgtaaaccttgtttattttatgttagtatttttttttcttggctcatgcattatgctcttttctcagtatcgaacagactttccaagttccatgaaggaacatgctgtgtttgttgatttggctccaaggtttcagctgttagcagaagaaatattgcagagacaagttcaccttgttatttataatttgaaggaggtactttctttattaaaatgcttgaagcatctagcgatatcttactaatagttgacatttgccttactgacctgcactttcccacatgtgcccatgtttataggctatagatggtgctgatggatttcagaatactcatcagatgaaacaatttgagtcagctaaatttagcatagaccaggtaattttcttgtctgtataatatgtctacaataaattaccattttctatcccgtatttttttatgccttatttcctttattcctttttttttctctctgtatccaacccacagggtgggggagatttattacataggttactagtattagttgatgtatttttagtttcacaaatgacatgactgagtgtacttgattaggttgttttcattctggaaaaagtacatatcatatgggagccgcttttgctgccttcaacttacaggagaagcatgtgtacagtcttagagtcagttttctcaagaattgctagagatatacttctgttagatgacatagctgcagaggagactttacaggtagaatgtataccataagtcaactaattaatgcttgcagttgcaccattgtatttcattagttggtcttaagcattattcctctcatattttcagctacaaagacttatttatttaatgctggaaaacctgtcttcattatttgagtcttgggcccctggagaacagaatttgcatgagttccctgcagagtctcttgaagattttatcccatccttacgtaaaatccgtaaactatcaggcatgcagtggcatcttcttaattatttctttaaaagatgttggttggattatcgttgactcatccatgacagctaatctcttcatctttcatttgcctcagaattattagatatgcctttaaaatccattacagcatcttgggagaataaagaattgctctcttgtggctttacaataacggaggtattatttgattattgatgactttgtttcatgaccttcttgggacaatatttttttttccttcatttatgttaattatttttaaacactgcccttggattgttattttatgtcagcttcaattagacagtgtcctaaaatgacttaatatatattatatctctcttgggcaaacacattatgtagattcttcaatctgactctctttctgattattctttacaacgttgtaatttgtttggacaaggctcctctaaagagcttatctttatttaatttaaagtgaaacacaatttaacttagtaaaattaaaggataaatacacccttgcttactttagagacattctcattttagaggagctttatcccatttgtttcacccagagtttcactgtatattcatgtgatgggactcattattacactaattctttcttcattttcctttagtggatgtttttccccttctgtttctagttcaaatactcctattttaaaaaggggggggggaagttatgggtcaaatggctactacaggaaaacataactgagttgattattagatttgattgaccagtatgttttgttatataaaaaatgattttaaatgccctgatctgatatcttttcctttactgtcttcttcatgttttgcaattttaaaaatattgtattagaactgtatctgatgagctttttcttcacaagcattctcacttgttatgtttcttacacgtctgattgttgaccttttttgcaggtggaagatttcataaaagctatatttacagactcacctttaagaaaagattgtttatggaggatacaaaatccgagcttttagaattcatctaacttcctactaaatttataaatcacgaagaacacactggagtttgagagtcagagatgatcgatcacctaggcaaatatcatgtgagtttgagctgctgctccaaatattacagctagcagaaagtacagattcgaagcagattcgtgctgacgaattttctgatgaggaggcttcgccataaagattttgtcgacaaaagtcttatgctgaagaagtaatagtctttttttctccttccttttccgtttaaagcaaaactggggaggggtttggtgcagagttgtgcctcgtttccattatagagcatcctaattgttactcattaacaggaaacacggatatgaattcaatggtagatatatacttgtaatgctgctactacaaggcagatttagtgagaccatttttagatgctgatagataaacgattgtggcacaaatgttggaaatagcatttttcattcaggtgttgtgattcgcattattacgttataaatgctacatttggttgcagtgtacaaattgcctacattacagttacgccactattggatgtatcgaccttatgtaatagaaataatttgttgattatatttaaatttaatccagtggtctataaaatgtcgagtttgtgttacaagacttaggaagacatcataacctagggatggaggtttatcaaagacaaatgtttcggttagcttaaaagttaaaagctacatctaaccaagacaattagtagttgacaaataacattgcttaacgaactaaaatcttaattctaatcataaattaagttaattttaatctaaattaacgaaataataaataattttgaattaatatgaaatattatatgtgatttatgtaaaaggaattttcaatttaatgatgagttttaaaaaaaataatattcaattaaaaattataaaatattataatagttattaaagttatgtaatataatctcttctgaaatttaaatatattttcaatagagatgcaaaggaaatcccttttagagttgtttacaattcgataatatttgaaaaatcaatccaaaaaattgaaccaaccaaaaaacctcaaacaaaaattgaaaatattattttttactgattggatcaaatttcagatttagtttttaaaaaaatcaatctaaattgaagttaaaagtgtatatacttttatttgtaaattttagtatgactcatttacatttttgtttcttatatattaataacttaattattaaacgcatatatatatatatatataattaaatataactttttaataactatttgaataaaaatatataaatataattatcaaaatgtaaatttattttactatatatttgaaaatttattctactattaaatatataatgacttattgatgcaatattttaacattttaatattttttattatgtttgtatcatgttttaccacttattatatattaccaatcaatccaaaataattcaacccaaatcactttaaattagatttgattgaatcaaatttaaattttaaactaatcataatttctctttaaaatccatccaatccaatctaattttcactggacaaggagctacaatccactagagatttaggtcataatggcatcatcaccctacgtatcaataactaatgatttatacaaaaggtagatcaaaaagttcctttgtcatgaaggttgaacctgttagctgaatgctcattgatagggaaaaagaaaataccaaaacatgctaacattttccggagatatatcagtagccactgaatgacatatatcaaaatcctcagagaagatctcactcattactagactggtcttttaacttggaacatggaaaaacagaacagtgatcacaataatcatgagaaacaagttgcctgtaacttaaaaatcggtggttgaaactttaatttggcataaattccttatataaattgatcatagctcatccttgcttgaagcatcttcccccattagttcttcaagagaaaattcatcctcctcaattatttctccatcttttccatcccatggttctgtctttacaatggttggagtgccttgcaggggcaaattccctttgcctccacgtccagcttctttcacaaattctctgaagaaaataaataggtaatatttaagcatttgtttatctcaataatgtgtttagcatttagcataaagttagaagaacaaacttacataatctggtcaagttcaaaagcactcttgagaggagcataaacagctttcttaaggttaagggctactaaagctggataaccataccctccaacacccacattcttctcaagatctggctgcttccctgcagctacccagacgtagctgtccacgacacaaaaattcaattaatattaagaatttgtcaacaaagactaattaaaatatgcatatataaagcatttgcaacattgatagaatcaaaaaatttagaaatgatgacattaactagcagagtgatattaaggtgtggtgtggaatctaagcgaaaagtacttttatacttgcctgtatggattccttttaaacttctctgcaacagatagtaactgctgaagatatatgtttctcccctcagccttggaatctaaaatgtcaggaaggaaggcaacaaaacagattgcggcagaaccacatttctcttccaaaacatcctatagagaaggttcatgttaattatcttaggcaaagcacaggttaaggaaacgaaataggaagtatttattaaaaaataaagcatttattgtatcaaaaacaaaaatcagttaatactttttttttgaataatcgaaatcatttaatatataatcagtgcgcttagggaactatcatcattcgttatcttgtattcctctctttcaaaccaatgcacaaccaaataggtaggtaggagagaaaatgcttactggactgtgtagctctgtcacttctggaggagcaacgtttgtttccagctgctctaatgcaaatgattcaatagccaaggcagttcttgcgccttcataaggaataggactatctttatcagcaccaaacaccaagattgttgggaatccttgaactttgaacctgctcattagagactgataacaaatatcctgtcagaataatataaacaaaaaagcataataaaaaaacattaataatgaacctgctcattaccttttcagcatcacagtcaacatggcccagtttaaccttccctttcaaattattggatgctttcttccactcaggagctaattttttacaatgtccacacctttgggaaataaaagagaatgaaagttattagagcgacaaatctgtaggaatactttaggttcagtcaggtaatcatgatatcaaaaattagattttggaacacaggaaacttaccaaggtgcgaaaaattccacaatccagagttctttgcttttgatcaccaattcatcaaagttgccagagttcaattctactgaagaactggtttctgtcttttcactagatcctcctgttgcttttccacttaaccgatccttcaaaagagcctttacctatacatgcagataattaatgtataaggaggcaatattttggagtaatggtattacattttactattttttttaaaaagcatattagaaacatgggagaaggacttagcagtgagtaacaaatcacaaaaattaattggtgaattacgatgtgatagtctgcccatttagatttttatttattattctgataaaaagttttccattgggcaacaacatatcaaacatcagttaatcaaaataaaccatgaattataacacaactgaatgcgagtgattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttatatagacctgtattaacaagtagtcacacaatgctcaaaccctaatcccaatacatccaaatcctcactctgcttagattttctacactaccaagtgatgtttaaaaagaatttccctttcaaatttttaataagaatcttgtttactttgtagtcattaaagttttcatagaaatacaagaaattgttttgtttgttacaaaagaggacatctatctactctatccaaagtccaacatcacacatgcaataacacttctcataaaacatcagatatattccaccacgtttggggcaaaaaggttataaaaaaaaccacatgagatcccaacaaacctgttgaagtgcaaattcagcaattggtttgacatctcttgctccttggtaatcaacaggtggctttccaggtgcaaacacttttattgttggaaatcctctaattccatattcctgtagagtagggaatcaagaaaaagttacacacacaaacacatgcgaaaatctaaatgtttttgaaacttccagattccaatataaattatgatgacaattgaagaaaacagccaataactgaaaacacctacaaggagtaaatgagcctcatgcaaatatgcagatgttatgaagaaacagaaaaagaatgtccaaagagatattctatcttgtacatgtaatatattctttggttgctttacatacacagtgggggctagatacgaaaactttacacatacaatattcttgcatgtagatattccatacaacaaacacgttaaccaaaatggctgaggtgattagatccaattaatcatattccaattatttgaaacagttcctagagctcaaatgattatgaataacaaagccgtgttttgcataatgcttgatccacaaaaaaggtatttccagtgtacattatacacaaaagttaagcatataataaagcgtcttcgtaattcagaaaaagctgactgcaagaaccaaagaacatatacagcatagtcttcattcaacagatttcaacatttaattatacataaaaatgccataattaaatgaagaaatgaacaatagacaacctgagccaaagacgggtgagcatcagcatcaattgccgccacagtaacaacacccttcaacacagtagctgccttctcccatataggagtcagagcttgacagtgtccacaccatggagcaaaaaattcaacaagaacaactccatttgaattcagaacctgcgaagaaccttgatatcagtcatcaaaactacaaccacaaaatatcaaacttggcatttacatgcccagatggatttcaagagcaaagatgggaaatttaacgtttatacgcaacaaacatttgaaaaaatggcaaaaacagtgagatcacgaaatggggtaatggagaaagggttaaaaaattaaacttgattcaccttggacttgaagttagagggagtgagttgaagcacgggtgaggatgctccatagagtgcgtatgaaggggcgaggttgaagatgaataacaaaagggaaaaagaaacgagaaatggggttcgaaattgagacttcgtcattgtctttctctcacgctttgcactctgaatctccccgcaggtaagaaaaaacccttcttggtttttctgttcgaggacttgctattgctacgtgtgtcatccaatcatatatttacacgtcagactcccactttggcaaatgaaatttcttttttttacataattgaaagttaaaataaagaatttgattaatgttaaaaataaaaataaaaaattcttacctttgattcaatctttgcatgatattagtaaaaaggaagcatattaccatggaaagtttttaaagccatgggcattttttttttttatctgcatagaaagaatattttacatgaaaaatacattagtatttgcatgaagaataatgtttaaattagagtaaaaacattaatatcttacatataaccttattgatattcttaaatgataaaataaaaatgtattgtactcggaaaaacatttttatatgaaagtacatttatagtctttataaaaaaactatccatataaaaacttattaagatttatagatctattttctatagatgtactttttaagaatataaaaacttattaacttgattctgttttttttatatatacaaacatatcaatatgtaaattattatagatgtttattttaatagaaatttcacataatttttttcctaatatataatacttataaacattttttatatgtgcacaataaagacatataaatgttcccacaggtcaataaactagtttagtttaaaaagtaattactctttaacactttttgtctatataagatatatcaatagttgaagaataataaataatttacatgttaaaaaatttcctacttatttttcatcacataaattaacatgaaacatacccatgttctgtgtttctaagaacttctccatagtattaatattgccttgagtgtatgataaaccctatatagaaatgcatatatctgccattacctataatgtgttacttattgagggagaagcgttggggttgctcaaagctcttacttggatgacagatatcagccttactcatcttattttggagtgaaattgcaaaatagttgaagataaaattaacagttttgcaacagaagatacagagataggagatattattgctgagtgtaaaaacatacttgtgcagaatccaaggaatggactttgtaaagagacacgcaaatattgttgcacacttgcttgcaaggagagcaacatatcacgctaggctcaaagattttcattatatcccttctcgtatcatgaatgaaatgtcttaattccgttcttgtaaaaacaattagaatgtgttacgtttatattaattgttgcgaactagagtcagagaccaaactgttagaacttagaaggtaaagaggcatataaatccaccttttgatccattccaggcatcatctaactttcatcattcgttcgggatacctccagatcaaaacactgattccactacgtaagttactaagtatgacagactgtcacttcaaattcgaatgtgcaagatgcatctccatctccatgtattttattagatcgtttacttgtaacttgtaaagtacaaccatggcatcaactccaataagtaaaccattggaatagaccacattccaacttagattacacaaccttgaaccttgggtccatcatttgttggaatttttgtttcacgtctttcttactagttgtctgaacagattcaagtaaaccattataacactcgttttattttccaccttagagacaagtcccacatccaatagtttcttatataagtcattctttataaacctctaacatgggagtcagtttgccgagctgagtaacgttagcttgtaacctaagtaggggccctaaagtgatgggacatggctcgggctatgctcggtcgggttggtagatgcataatgctggtctgcccgctccaagttaagagatgagtcatgggacttgggcgaaggctcaggtgtcctgactcctaaactggagggcatagcgtgaggctggtttaacagagcagcgatcaccaccggctcctgacagtggggggataacaggctgcagcaattccaacccaccatgactgggtataccaagctcctgaaccatcatttttttttttttttttttttgtgtaatgaatcaagtgaaattcacactttcttaatacaacaagtggttttttatatatagtttaaaaaaagttaaactatcaataacaatttctgggactaatttattattgtcaagatacaccagcctttagcagtttaccttcccaagagaagcccttttgaataatcatcctagaaccagacgtttctacaaacctccaatcaagcttgcaaatcaaatttgtcattagagttatgaaaagaaagagcatccattaatgaagtgacattttggtgtacctgaggagaatgttctagaggatcagattaattgatcacaagattccaaactaatattttatgttcctaatttcaattatttgctctagctgatcacagtatgttaagcacctttagtcaaaggaattattacatagtcttagaccaattatatgtccataattttaatcactctctactaagtaggtgaaattttcaattttcgagaaaattcataaaacacaactataagagattagttgagaccataacgatctcaaaacatataataatttctccttttaactgagactgacctctaaattttaaatattattacatgccaagaagatatattttaagtttcattcacgaacctctaaattttcaaggttttggagtctcatgcatcgtgtgggacccttacgtacatacttcaagtcagctaacatatcttttaaatatgatggatctagctttcatcactgggaagtcctgctagttgtaaaacgctttatatttatatttttcggttccaaactcataatgtttctcatttttgagtctgtaatgctgaaatttcgtgatcctatgcacaacgagtggccaagatcccgcaaaaagaacttgatgcacgttagtggataacaattctatgttttcgaacatatgggcatgtatttaatcacaatttcaactgttaattttctattcaactactataagtttacactatcttctaaagtttatgaaataactgtgggtaagatgaagctggcaggttgtgtgagatattatcatttatttatcacaaatcaaaccacttctttctcaacaacaatatcaggatttatagtttcttctagcctttttagcatggtcttacaccttttttattttcccttctccctggtcgtgcctcaccaaatccctcacatgattggtaaaattgaatccataacaaagtgaacttccacatggctatatttaaacaagggaaataagccatgagtcaaatcatcaaattaatgctgttttgctagtatgagtatgtcttgaccatagctgcataatacattcttcttaaagccttttgggtccatattagaaacaatcatgattcataagttcctaatagcaagtgccaagaaatgtatttccttacaaccaagctgtgctagttaaaacatgactaccttgatgattcatttaagtgtaatgttgataaattagcttcaccgtatgatgtagaatcttgatgatacaaagctttaggtttgtggttttgcaacaagcctaggctggctttagatcttgtgaagttacactcaagaattgttaaaaattgttccacaagaaacggcatagaaaagaatgagagaaattgctccacaagaaatactgtaaaatcatgattataattatacatgaaaaaccggtttaatccagatttggatgacacgctgaagtaagattataggaatttcctttaataatatcatcttctgtgaaattacatactgacatttccgtgctattcaattctatgatttagagataggtaatggcaatattctataaggagtattattcactagatatcactgaagcctaaagaaagatataagaggttcatatacatctcggtgagcattttcacccataacataatctgcatgtgcataatcatttctgtactgcactacaagcttatctgcatcgtgatctttgaggatttctaacagacgttgcacatccttaacatcagaaagagcatcagcccctccataactcaggaagagaggaaggtcatttggaagtcttgtcatgtcatatgctggaggagtgggttgtccatagtgtttcatgttctcatctcggttttcgtaatcaaacattgaagtggttccttctctgatcactgatatccatatatgattaaaattcatatcacctcatgaaaaacaaaaaactattcttattaacatctgttatcagttaaatttccaacatctatgctaataagtaatatgcttcctttttatagggtattggtgtctacatgatatttaaattagggaaatatgaccacttactctgagatagatggatcatgttctttgttgctgttgactgaggctcatgatccaaaaaaacatttacaatcgaagggttcaggcagcagttttgacctgaaagcataatagtgtcgtcaatgtaggaaacaaagtgttaaatatagagatttcttttggtggttggtgggagggggttcctcagggttaatagcataataattacatgaatgaaacctgtgaaagaggtcaacaagttggtgcagtcaatgcctgtgttattgcacaagtcctttagaaacttaataacagagcccctattcaaacatgagaaaaaaaatgaaatgaaacaaatcctcatatgattggagtcactaacaagattagtcataaactggtttacttctcaatttcatcctccaaatttatttatgactattatcacgtcttacagaaaatttggttaccaaattagtccctcaaaaatttaaaacattgttgtatttgtctaatttggtgaaagattagatatttgaagacatttcactgataaaatctttggaggaccaatgtggtgacataaaagaatctttggaggaccaatgtggtgacataaaagaatctttggaggaccaatgtggtgacataaaagaatctttgaaggactaatttggtgactaaaatgtttgaaagactaatgtgatgatgcatataactttggaggatcaaattcatggttttcttaaatattagttataatttacattcaatggaaagcacaatttcacgtcaggatggattctgactctgatcttattctatccaccaagaattttgtgaaatgtcttgaggaagtaacattgcagccttcttattcttagccaaagtgcagagaaattaatgacaatgaatgatagataatgagtgttacttaccctctcatattaaattcaaagattcccaaattgtacagtgactgttagaaaaaaaaaaacagatttttagtgtcaatcttttgaattttaaacagaaattttcttttccttttttctttgtgcaaaaataaaagcatgttcataactaaatacctctgcaataaagttttcagcagcatttttagctaggggtgaagtcatctgaccaacataagcaattgggctaagtaaggcagctgatctcaacatgttcagtaactgatcttgggaaagagcagccaatgcaatcaaagttccctacaaaagaattcaacactcttcagtcagcaacacattgaataagtcaaagacaagaagagcaagtgtagcatgcgaaattcacctgtgagtgaccaacatagtgcaatttttttccagttagatcatgcacatacttgaatgtggctggaagatcatgtgcaactaattcatcccatgaccaattccaataatcctaaataaaaaaaacttgcataagcaataggaccaatcaaattgctgaccacagaagtgaaacaacattttcaaacaaactaaccgagctattagaaggtaaagatgtatgttgccggctaaatttagttccacgagtgttagcaacccaaacatcaaacccattatccaccaaaaggaacgcaagagactggtttgaaggtagcaataaccatgttatgccatcctgcaaccacaacatcacattaattgccaacatcaactacaaaatccatgacacatagttgcttatgacactattaatttagtaaccatgaaaagtccatgctgtagaagaaccggtggcccccttgattctcccattctaattcttgccaagttaagaatataaccatcttgtgttgtcacctaaaaaccattacaaaataagccagttagtagctactagctgctctaaatcttgctcatttctggtcagaaacaataaacagatgcaagcacagtacataccaagtgttctccacaagtgtagccttgtgtcatcaccattgatgagcaaataccatcactggggggtgatgacaatgtagcggtagtgctaagtggtgataattttctcccagttgcaagagttaaaccccagaagagaatcacaaggactgttgagactgatgtggccatgttctgtttcctggtacattaatcttcccaatccagacattattatttatacacgcagaaaacaggaaaaaataatagtactaaggtattcacatgaggggttttaaaccaccttttttgtcaacagtggtttaaacaaaagtatttgtggggtctaccaaggagccactattaaattataagattttaataccaaaaaagaaattataagattttggattttgttgccacggttctttaactttgaaagtaatgtgtggatggtttttcaccgcagaggtgactcctgaccagaccaatgtggctcatataaaaagccaaaacatgtgccttcaagaaaatgttatgccatagttgatctaagttttgtcccacaaagcatacccaagtcttgcttccaaataactaaagtaacacactggaagtcttgcttattttagacgcatggcattttacagatgtattcacacttatgataaactaacaaattagcttgattaataagtatccaatacattgtactgatatttttcaaattgttaggagtaattagcttgttaggtatactagcaggttgttagtttgttagtagtatttgtcaattttaattagctctatagcaaattaataggacaatatttaaaactattgttgaaatataaatgattaatttaaataaatatataatacacattcaagtttgcaattagtaagtaatgaggattgaattattattactcgttcctttgagtaagtaatgaggatttagtagctgaagttataataattgatactaagtaaccaataattaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaagaagtgaaaagatctatgttggttgtgaaggttgattaagttcaaacagtatgaataaccattggatacaagacgaagataatggacaaattgcttatgtggctaaataataaagatttaagttatcgaaatgatattttcactgcttgtccttcaaattgcttggagttttcatttttcaattaaaactaagaatatgaagagaataatgtaatagaagagtaaggaaaattaagatatttttttttttgggtgaattcaaatattccaaacgggagctatagataaattcttcaaactcttgatctattgtttaaggcaagagttatttgccaaattatgtcacattttatttttgttggtttaagagatattcaccactagataattaaaaaaaaaatcaagaagtgaaaaggctagaaataatgtgactaacgcatcggtgacgagtgtttatttaatggacaatgaaaggaattaaaaattgggagatgaaaagataagtaaaaacttaacgtgtatataacaaaatttgcttacataacaattaacaataaaatatggtataaaatagcaaacgtatacctttttacgcaattttgaactgaaaacacttgatatctatctttaaaatggataattttcaacgtagcattggtattgacacgttttagatatgttctgtgcatttcatctctttgatttaaccatcttggggatgctttcttagtcattatctaataaattaacatcaaattcatcagctgtaatttcctgaatctctaaaaggttgcttatttgggtgaattatttaagcattagaagaaagcttttcaggtgaagacgttgattctagaaaattttcatctctataaaaaaatcctcttgaatattgaattacttctttttagtgtccaaccattgtacattgttaagataactttaccactcattaaaaaacttaaatcattattacgtaaaaaaattggtttaataggaacatatcaaatgacattgtgacaagacaagtatgagaagctgattttagttatctatcatgttaaaggtaatcttggccatagattttaagttttagaccaagactaacccttcctccattctcacaccactgtgaactataagacgtggatatatttgagtgttaacctaatagtactctcgtgtacatttttccttcaatctcacactaatgatcaattctactgaattatgagaaatgctaccaacaaactttttaatactttcttttcaatattttattttctaatatgtaaaattaatttaagtctcactaaatatttggatcttttatctcatagcgagtctcattcccaagctactggaatcctcatgaattgaacaaataggagagggaatattggaaacaaagtattaaataggagaggaaatattggaaacaaactattagaaagtatgctcctatcactcatcttaaattattatcttgatggaaaattttgttgttaaaattacactattaagaacttgttcattccccttgcaacacaaatttactattcagaaaagtttaaattgaatagacgtaacaaaaagtggaaagagagagatctatttgccagcccccaaaattaaaggatgtgtatttcagtatttcctccattataaattgatcaaaacagaacataagtttctaaagcactcctcccatgagggatgaagaatttatgaagctaagggcgagcaactgcaggccaaaataaaatatcagagcaaaatttgatgattattgataataactaagttgctactctgtttgtctaattgaaagcctaatccagtatctgcagccatctctatcaatattggtgcttgaaagaaccatttatagtagtgtactaatcggattttacagcaatatgtgtggtagaagcatcctttatacgtgtttcaggttttttgtggcagtgtcagacactttgaatcttgtaagtttccttctaaggaactggaattgaaaccctctaggctttatcttcccaagcaattgccatcttttaggtgtaatctgtcctagcattttcatctgctcctttcggaacttcttagttgcataccagattccacctctccatcctaaggcatacctgtatataagcttaagtgagaacttgtaactaaaaggaaattaaaatgtttaaacccattgaatgcaaaatatcaaaagaaaataaaagtcaatgtgcatggcttatgaagtaaaaacacatttgacagaggaaacttgttcatgtcaaacatgtattatgccaacccaatgtgaaatcaaataagtttgacatcatactagtactatcatatatttcaaactaagaaacaaccatattgaggaatgatatgtatttgagaaaacaggaaccagagataagaaatgaaatgtgtaagagtttaagggagagagtgacacattatgcccccaccccttcccatttttcctcccactcccaaatttcttctctatttgccaaactacacctgatattaatcttcgccattgattgattatttttgtcatcctaaaaaatttatgaaaccattagtatatgaaataaaaaattcgtgtaaacttttagttctgtcatccgcattcctcctctcagtgtatttataaccttgctcacagtccctctacctctacacacaaatcaatattctgtcccatgtttccctagtacataacataaaacaacaatccaagaaaaatcccaaaatagataaattggtcgggggtttgtcgacaagggcagcagcatggtacgtaaacttgctgaatgtgggggccatatatttaactgtaggtgtgaagaagaacccaaagcgttttgggcaagcagaattatttgagtgttatgtcagaatggtaaattcaatcactaaggaaagaatcacaatgatctgaacaagagatttagagtcaatggatgagtcagggcaagactttccgctataataacttatagttatacacaattaaacttctctaactaataattaacttaagctgtgtagtttatcatcaaaacattctaatcatacagaaaccaaagccctattccaactcagtatttcatgataaccatggcatactataacctttcaagtttttgcatttcactatagaaattttccaaccaacaacattcatactttttgtttatgtcccacaaactcagtgaatgctctctctctttatttttcaattacaccaatgatatcaatgctagctagctagcattatctcctgaaatataactaacaatatgttaaggagcagagcatgttgtttgcaagtaagtgtgggaacaaacccgatgattaaggaggttccagcagtggcgacacaagcagggatactacaacctccggaagcggaacccgagacaatgtctttgatttcggaatgtttgagattggaattgtttttcatctacagcatgcatatttagatgaagcaagagaaagaaaaaacaaaagtaaaaggaaagagatgtagatagatggatacagacagcattttcgatagattgaagcctttgatcaactttggtgtcatgtaaatggcgcaaggaataacctgagaaataaaaaagtgagtgaggggtagttattgttatgcaaacagaaagaagagaatagagagaaacacggaccgaaccaagcagtagcaacggaagcaatggaagttccaacggtgaaaaccacgcgatgtctctcaaaagtatcctatacaaacacaaattcatgacatgagatgaaggaatcataaacagaaacataggacgaaacgaataccttggtggaaaaataagtatcttgaatggcagcccgtgaattgaggtacttttttttaaggttgggcgccgacaacactgaactccttaatcgctgcatttcatatcatacggcgttcttcccacgctcaaataacaacctgccactgccactgcgactgccagggaaaactggttacttctttcccaattcaattcatctccccaaaattatatctaaaaaactgcaaattagtaataatagacttttgggctttggcctatttcacccaaaatttcaactaacaggactattacttctataaggaagctactattggtctcaacctactttgctattagtctcaaccttccgacagaaaagtccattttacccctcccttttcctccttcctcttcccccatcatcccacccactccctacgcccccaccttcttttcacccaacccctcacagctccaccctccccccaccacagtcacgcaaccatcatcatcatcaaccacctctgtgttgctccacctccctatcccatctcttccgtgtcatgccaccaccatcactatgctaccatgcacatccatcgttgcgtactcctctaccataaacggaatcacatttccgtatggacatttggccacatagaaacgtgattttgttgtgttaaggggggtgccgcaaaatataacaatggaatcacgatttcgttgttatgtttgggatgagaaaaattatacaacggaatcatgattctattgtgtatgaatacaacagaatcatgattccattgtagtaagggggtgaaaactagtgcatgatggaatcatgataccgttgtgcattttgttcaacggagtcacgatttcattgtttataagggagacaaaaactgattggtaacggaatcgtgattccgtggggagagtgtttttgaaataaaaaagtctcaatctcttggtaggagccaagagcaattaccaagggaccaatagtaaattccttgctcaaaaataaaatattcatttgtacatttatcataaaaaaaaaaattatatgtgtttcacatatatatttcaaaacttgtgacttataattatgataagaaatttttgaaaaaaaaaatccccttctgaaaattcaaagaaaaactgttataacaagtttattatctttttaaataattatcttaaaacaattcaaatgatgatttatgattgaattacaatataaaactattttatattgtgagtgtataaacattaatctcgtaaatttattatgcctaatgattaataatacatcaaattagttcattaaattataagttttgattcatttagttttttaagttacgaatatctcaattttaataaatatatatactgataatggagaagtatttaatattatcaactaataataaacgattatgtaaaataaatttgttatttttatattaaccttaaaaataataataaaaataatttatgattgatttaaaactatcattgttaatatataaaaaaaattagatgtcatttcaaaattttaaaaaaaaaaaaaaactcgtttattactgtcaaacaccgaaatgactgtcatttaaaaattctaaagattaaaattgacattgtttaatttcaaaatctaaattaataataattttagtgattaatttagtgtgtaaattctgttgctgtagagacattgacaatgcatattacaaaaagcagttctactatgaaaaagaaaattataatgtattaaaatatcaagtttttacaacgaggctcatcaatgtctctttagtctgactgacaatgagcttactttcttttaaactagatttcaggtttaaaatggaaacttgaaaaagttgtctcggtgaaatagtacatccaagttgactttagattagtcgtgtgggggagggagtatgagatgatacacaaacaagtgcaaccaatactgatttctctaatgcatatgtttctttcggataagaatgcttgtttgaaactatgatgagggctaaccaaggatccaaaacattacaatcaccacttatctacaagttgtctatcttaagtcttaacatttgtctcatatttttacaaggcggacatcactctgtccaaatgctgttccacatgcaggacatttgcggtgccgaagctctagatttctctgaatgcatggattgcagaacagatgatagcacttgacaatcacaacctgccaaatacacacatcaaacttttaggtgtttctgttgcaatatattctattctagatactactacgtataaacatgcagtgcaaatccaagaaaggatgtcaaattagctttgtattttcttcatttcaaaagaatcatggtacatggcacaagtcatataactacaatgtgaaagcaagaaagtgtatgtaattggataagttggcttgtggttacctcctttggacgatcagtacagacagtacacttgatcatgttcttgcaaatccttatttctttttcaagtttttgtatcgtggtttctccagtttcagaagtcagctcgtcaattttgcagttcaattctcttagttcttcctcaagcttcttccgtaaactcctgcacgacatataccaagattcttgagctctaaaactacttttgcgattcattgcttattcaatccctaaccaacatttctaattcatcattttcacaaaacttgagattttatatctctaggtcattattagaattaaaattgtatcagcgagttgcttggtgcagatgtaaaaacccttgcttgaaatcctatccctggtccaaatttgacataaaatcaacctccttaggaaaaaaaaatacctttcactctccaattccatttcaatagcttccgtatctttttgaatttgatcgtattctttctctgaagaggaaacagcagacttgagcaacttcaattccttctcggcatcagccaattcccattttgcaaattccagggtgactgcaaggtgtttttcttcttggttacatttaatggcatcggatagaatagctttcatctacaggattcaattttttgtttaaacagtaagcagctgctgcagcaaatttgttcggcataaaatcaaaataaattcgaaaagacagcagggcaagtttgacctgctcttcactgtgtgtaatcctcgtctttgaattttctattgatgtattaatttgctttagttgcttagctaaagcctgcttctgggacattaaagtgttgtgcgcctgttttgtcttcacgctatctgatacaagctgcattaagattgcaatattaattaaaaaaagtggtattactaaccaaaagtcaaattatttaagaacacatgcacttgctttcagtaaatagcacaacattcagtgcatattaagttcctgctgttagagtgagattttgtccttccaaaatcaattcctacagcaaaaattcatgtgtttgagagaattgatttgtctaggtatttctccgaaatcaattatcccaaatttctaggttgatccagagttgattctaggagatgcttcccaccaattctccaaaaaccttcttaatttgattcaatcttgtaagattcaccataatttatataaaccctctttagtagtttgacacttctaaaatgatttttttatacattaaccagatatgcaaattttttcagatcaattcatacataaccagttcttcaaaatattaactaacatatatttctaatttatattagctacaaagttgaaggatatgtttttcatcaagcagattagcaaaagccaggataataacctaagcattacagtagtgcacggaaagatggtgaagataataacaaggcagtgtttagtaaagataaaagtaagacataccttaatattgtattcatccctctcgatcacctggtccaacagattttggttctgtgtttgcatatcttcatatgcttgaccaatagtctgcacaaaagcaatcaaataattatattacaagaaataagagttagagtatgaaggggaagaaaaagtcagatagcaaacctcaatttcagatatatatgcctctgcctcagcatctttaactttaacagcctcagtcagctccaaaatatccctgaatacggaaagataaaacgtgcatcaacagattaatagaaaagccagattgtacaacatttattcctttcatatgaagacaatcaatatgaaaaaaccaaaatgctaaaaaaagagagagaaaaaaacattttacttttctatctgacaaagcaaatacaagcaagtgtacgaaaatcacggtatcaaacaactgatataacaaataaaaagaactctgttaagacattcttttgagttatacatgtttcaaaatcaattttattttcattaaaactgtatatgttaaagtataaaagtataaaaccattgttgtatcttcacttaacatcttaagcttttaggttaattggttaatgacatggtatcggagcctctctgaccaagtagcctagagtttggtcattgcaacccctatttttaaaaaatattaaatttcatcccaaggtaaggtgggcctgtatatttatatgctattaagtttttggaataattgattaatgaagtatacaaaatctaagtttagttatttttccccaagaaaatgttacaaggattacagacatgtcaatcaggtttataatataattatgtatgcttatgtttagagttgtttctccaaaaattaatttaaaatatttattcttccataaatacatgttaatacttagctccccaattaaaccgttagtcctcaacgtgtttccatcctcctcatattcctacaactgtaatatttatatttattctcattttataaggcatagtgtaactgcgattctgacctttgccaaataacatgatgtggcatattaaatatcccaaatgaactaatggtaccaatgaaataaatattgtttcatttcagaaattccatgccttggtaacttgttggtcatgggttcgaatcttgaaacagcctctttgcatatgcaaagataagactgcgtacaatatctctcccccttatcttcgcatagcgaggagcctctggacaatgggacatgtagtttttttttcccagaaatttcacacctcaaattcactccatgataaaactcaaaggggctcatgcaaatagcctaacacattctcccaagtatgcagtcataaatgtaaagcagcatagtatattggccaaaagagaaagtccttcaacaactctataaactttagcccgtctaccttccccactcctcatcaccagaaacttttctcccaaaataaacaaacacaaatatttataaggttagaaaaaacaaaagacactacacaagtttgtccatgaagcaaaatatcataatcagtgtagaagtacacctaaacaccaacctctcagatgcatccagcttggacctcaagtcctctatttcagcttctgcagcagaaagcctttgttcacaagcagcttcagcttcattagcagcttttactctcaactctaagctatgctcgtctaaagcatttttcagcatttcagcttgagagtgagccttactttcagattctcttacttctgaatatctgaaattcaaggtttatcaagatcaaatcatccaagtatacagatgagaataaaattgagttgaatgcaaaataaattctctagttggttaccaagtacaactaaatgtttatcttatgttaaattgaacactaaaacctttacaaattgtgcaccatgaacagaaacacttgagaccaaaggaaaagactaaaaactacatatatttctggttgactaatctgtacaaaggatactgaatatgtagattagatacagagagaagattacggccacgggcttgcttggtatccactacccctcttccccttggactggggagacatatgagacagttgataaaagtctcaattgagatgtcaatcatgtcatagaatagacacgttgagccttctttcaaatatcatagcatgtagtgtaggagagataatgaaccaacaatgaaagttcaatggactgccacaaaagagagaccaatggtagtctccctgcactcaatcatcacataacttggcatcaaataattggtggtcagtggaaacctagttcctaggctgatactgagtgcaactcctcagacactaatacccatgaacagtaaagtaaatgcgttttatcatgcgaaacattaacatactagtttctaagtgcattaactaatattatttccaacagtatgtgcaaaaatcaccacactatgatgtatcagatatactttataagaaattttacctcataaatttaactgcatgaaattattgccaacacttgatttccaatcagcataccttttatcataattctcctggccatgcatatccagaacaaactctaattcctgattctccttctgtaacttttcagtctgcaccaaaatattttaatcaactatttgaaaattagtttagacaatcaataagacctctaaaatcacaatcaaataatcctagataattttagaaagcaaagatgcatatgcacatgcatgatacaagtcgaagacaaaaggtaaacatttgcaatatctgtttcagtcacagacatactcaagattcataaagtaatagataagtggcatctatcaaacttaaacccaaacaagacaactgagaagttttactgctatacaacagaggtaattgaagaagaaaatacctatagatcaagaaagacacaaagataaagccaagagaagacttaccaatgtttttaaagacttgatttccaaaacctgttcagcacatttgtttgcaaggctcttcagttcatttgtctgcttcaaaacaaagtaattaacaaaccttaatgctaaaaaaagtatatatattgtttgtattcaatggcaaaacctttggcctatttcagcacgttccaactaacatgacttctcatgtcattaaattcaaaatggtgttagtcaaaataaatatttccaatttgatcaatgaccacattttatcatatactaaccagtgttttatccaataaccatgatttattacaacagtagtggacggtttttgttaacttgtatcagattggaagtttctcattgactttctataatttaacatgcatacagaattatgttcattaaacaaagaaatggacacttggagttcaatgtctataggaacaattaacaactttgcagcatatatttgtgggattcaataatgtcattttacgttgtcaacaaagttaaaagagcttttacttgtcaggtcatgctagagatatatttcaaaaccattcttgcctttttcccaacagcttagcattttagtgaaatcatttcttgacattttacaacaaaaattaagatggctaaagacttgtgctctcatgaaagcccaactccttgtaaaagtgacaatccattgtatagactcaatctaagtagataaatttctgtggaagacctatcacaaaataagtgggaaagaaaatgaaagggcaaattatattggatcaaccttcgtgctcaatgcttctcttagtgaatgtgctttctcacgtaataatacagcctcatgagctgcatctttccatcgctttaattgaccttccatcattcccatttctttagataaagctgaagccataacatgaaactcagatttgatatcttttctccctgaaacgtttaatgttgtaagaaactgggatccaatcacatgcaccacaagtctaaacacagaacaagttatatgctgaccagtatcctgtttagcttcttccattttaatttcaagatcattcttttcaataatacacttctgcaactgaagctctaggtcatcaatcctatggtcagaattgccaaggatctgccttgcactatcagcagactccaatttcaaatttagttcattctcccattttgcaacatgaacactgccagcctaaaatagcatttagaataaaaattgtaaaaggagaaatgacaaatattaaattaaaaccagacttttacactactaaaggggaaaaaggaaatcattgttaacctgcagagattctaccgatgttttatatcgggccaattcagtcatccaatgttgaagttgatcattagccaaagagtatattcgagaagtgcgcacatacttatcatctttcagttcattctggaaataaacatagaagaaaataaacttttacatgaactctataataaatgcatcttaacaattcgagaaaatatgactaaaccatcatattagataatccaaacttacaaacctgaagatcatggaactgctttgtcaaggtctgattgtcttcttgtgcatcttgaagctcagaaagacgatcagcatccactatctatgacattaagcaaccatatatcttcattacatagataacaaggacaaatgaattacagatacagagagaaagataatcacacaacaaaaacctttgcttcctcaattgaatccttcaactcacgcaaatccatggtcctgtcagcaatgttttcaggggacaggtttccattcactgcatctgcattgggggaattcattcctattgctgcatccttttgcatttccagattgactagttttcttctactctcttcaagttcagccacaatctcatcaagctcacctttacatatgacaagacactcacaggtgacaattatgccaaaattataccaaaaatctctgcataaatctaaggacattacttcaggtcatatctattcctaactaattctaaccagaccaattataatcactgtaacttaactcttcctgataatttccctaaattactgaattatgcagttgcataattacaattctctccctactcagcacaatacaaaacatcctctactgaggctgttattacttctaaattatatttgaatttcacaataggtattgggtgagccttgacacaacagtaaggttgctgccttatgaccagtcattgattcaaatcctggaaacagcctatctgctagtagggttaattaagactacatctacctccccaagccccaattggtgggagcctcatgaattgagtcaccttttttaaatagctgtccttgcatttctattcatcaaacttaaaatgtgcatatacattggaatattcaacaattaaaattaaaactaaaatcaaatcatatgcactcaaatcaaccaaattgagtgaatttctatttatacaaaactaaaataaaaaggatttcaaaatcaaatcaattaccattttataattttccaaacaagaaatttcaattttataagttttcaaacaaaaaactccatttataaatcacctaaatttcttaaaatactccattcccaacaataacatttcttcaattttcaatgttttaaagaccagctcattccaaactgcatggcttcattagcttgtcattaacttttaatgactatccccaagccagactgctgatctaatcaaagtactgcactgcacatttacttctccttctacttagcatcgactagataataggttttctaatttaactttggcttaaccttttttttggtgagcaatacaagaagaacgtagaaacctctacaaaaacgaatatcaactaaatcagctcgtaaagcattacaaaatgaagtccggtgcaatgtcaaatatatgaaattgagaaggaatctacaaataaggagttgcaaatgaacaatattttcaaataacaaactaatcaatcatcaaagcaataagagatgaacaatgtgcaaaagatattcaatgtaccatttagccgtaagagatgctccaaaaaatttagagtaagcgcccattttggtcctcaatttttttttaaaaaacattcaatttatttctagaaagagtattacacaaatttagtcctggaaaaatactatttttcagtgattaaaatggagattgattcatacatcatataatattacactttaactgaaaaagatcatcaagcacaaggaaaccttcctttattcaaccatggcacgtaccatttaaatcatagcatatgataatcaatatcattaaaattcacactttttaatattctaaacttcataataactgaagtagttaaacaaaagaaaaagaaacatttcagagacctgcaaggcgtttaatctcagattgatcttgtgagcactcattgatagaattttgaatagcaactgtatactctttatgttttgcatggagagtatcaaccacttcacggaaattatctacctcctctttcgtcatatcatcaatcttagacatttggattatagcatctgcaaaccaagaatgagagacaataacagatcatttatataaatttattcaaagtatcctacaacattgatatcagatagaaaaagaacaaatcaatcattaacaaaaactatatacagcaaccggataccttcagaagataaatctccatgtaaaacctgagctataccacctgctctttccatctgatcatcaatggtatctttcaggagtttcaacagctcccttgtatatgactgacgcaaagcaagggcctcctcaacataactaatgatctcatcatcactgattcccttaatggaatctttctggattaatctacatagaaacatatcctcagcaggacacaaaggaactgaacctagagagtaaatcaagtcagtctcttgaattacctttatactgtaagaaaaaaactacttgtgggtgtgtataccttgaggattatcaatgtcagtcaaatgttgcaatgtgtctttgcctttgcctctcccagctcgtattccaagaagaatcatatcatcaaccaactaggacaacaaattagaaaaactaagccagctagcatattatcctacaagaatatgacaaaaaatgcattgcctcccaccctccaacaacccacaaggccaccgaagcatgcacttcatacagtagtgttactttcaagagaggaaaatactaaatccaacagagtgcagcccgtaaagaaaccaaagcatgatgacaaagaataacctgagtccagaattggttcaatgcaattaacaagtcgtcattggaacttcgctttccttttaattctctaattttttcttcaagatcatgcaaagcatgtttttggatgtctatctgttgaacaagctgttgattctgaaactgtaagactcccgcgtcggcctggagggagcatatcatttcccgttacataattaaaactaattaaaaactaacattgaaaaaaaaaaattatgccacaaagaaagagttgttgtgatgataaacaagagaccaaacatttttttaccacaaactctagtcaaacacctcaaagctcataaaaaaccttgcgcatctaaatttttcattttcaaaatatacatctatattttaaatgaaagactctcaatgacatgaaagcatgacacaatgcaaagaatcataagacatcaaaatccaaccttgctactcttcatagcccagtcagcactcagcagtaagttggcactaagcacaatcaaactgccacccccttctcataaagatcaaaattttatctaaaactacactaccccaggactaaagaggcaattcattttgtgcccacgagaccaaacagctcagagaatccaattacacacccaatttcacatttcactaaaattcagaacaagatcatcaacggaacacacaggacaacattgagatagaagaacacagaatatatataaacacatggatacacaatcatgtagagggagaaaaaggggttacagttttgttgttggtaggagagttgatggagtttcgaggagtgcgggaagagacagaggtgagatgaggcctcttcttttcgggctcgtcgtggtctgagttttccattaagattctgaaattttgaccaaaacccaccacagcattagtaatcaaaatcaatacttgctcaattcttatgagttctctaggaataaacaagaaattgaatcaatatacagctctcctactcttacaaactaaaaagtttagggtgatgaacactgttgaccacttttgcatttatattttaaaaaaatagtattttttactaagtgtattcataaaataaatatttatttttatatagttataatttaaaaataaatattttaaaattataaattatactataattaaaatatataaaaatatttttaaatatgtaaatcatatgttaaatatgaattataatctaaaattttaaattgaaatggataaatcattaagaaaattaaatatatacattttttataagaaaatcaaatatatagattttttataggaaaatcaaatatatagatagaaacaaaagaaaagttgtttgagataattattagagataccgaaatccagatttatttgtgaggtgaatactattcattggctccaagaggtgttgtttattggtttttttttttgtcttacttttcattttttcaaatagaagtggatcaagtgtgttttctgggcttttttttacctttcaagggtaaacttttttaaaattagtaaaaaaatatatttttaaaatttattataaaagatgaataagttatgttttaaaaatacaatttcatgtaaaacaatcgtgttttaaaatataattttgctttgactttttttaaaaatataaaaaagtcatattttatcttattgttttcacaattgttttatattctaaatcattgaagtcgtacactaaatgatgactttagtttttttaataaattagaatagtgcatgacaaagctagtgaagcaactgtgtatgtcaataaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatttcagcttgttaattgttactttttttcacctggttattattacaaaataaaatacatcaaatattatagttgatagaaacaacttatcaaatattttttataaaatatatatttcatatttatttacatttaaaaagaaaaaatagaacataattagcctagttctataatcattaaagatgagtctaatttttaaaaatataatcataataatattgtggttggatttcatatttatattatttcacatttatatagtcaatatgaaataactaatttttataaatataatcataataatattgtggttggatttcagacttatattatttcatattcatatagtcaatataaaataattgttttattataatattatgtttgtaatgattaaaaaagagagaaatataaagattaaattatattttggataaatagtcattttcgtccttgaatgtatagagtactaacaaattcgtccctgaatgtgccagaaaactctttcatgaacgataacgaacggaaattaacgaataaataaatttgtcgtacatttttcattttcagagactaaaattgctatttacccttttttaaaagatctcgcttcaaatttgtaataatgcacttcctctattttgttataattgtcatataagagaaaataaattattataaaataattatcattttagttttttaatgtaatattaagtatttttttatttatatctcttataacattaatggttgacgaaaaaatttataaataaaataatgataatataagattacttttataaaattattattttatttaatctatttattgatttttatgtatgtgtaaaataacttagaacaaaaattataataatgggatagaggtaatatggtttttataatataatattaggatatataataaaatatatattattttataagatataataataatgtaaattgtattgggatgattaatattaaaagaagtattttaataaaatttatattgttttgtttgttctctaaattatttccattgtctaccaaatattatattggacaaaaaattatactaaaattcaagccttgtcatgtgttattttccttgtactatattttagtatgtactatcaaactcacccttaacattgtttacccaatagtttgcagccatttctttttcgaaacaatttcatacgaattttattcgtacgaatcaacacctgtatttcgaatataacaattgagccacatgcactcttctacccgaatatcatattaacattggcattaagcactaaaaacactccaagattccctatttgggcaccttaagtacataaaacaattacaagcgaaaaatttaaaagtaatcatctgtttatagcatcaataggttaagaaggaaaattaacctaccttgtccaaacaatgcaatacatacatgcataattagggtaggtagatgctttttttttcctagtaaatagtatatgtgcccattaggtttactgtttgtagggtctagtagaccttcgtttacattcatgtaatcctctttgtaattttgaggattgtgtttaggtaaaatttgacaagaaattccacaactgaacgcaaagtgttgttgtccaaatgttgttgtcgcatatcaaaatagggtcgcttttgggctgcaaatgtaagggcttaatttataatttctcacaacaacttgtctaattcatccttaattacaataattgtctattattatattatacccattttggtaatatcatatctaaaggctaaagtctaaacacatatcaggtttgttaaaatcatttctaaaaagatttaactattttcggaacaaattcaaaattgacacaatctatttgtgaatgcgtaaatgatttaatctttgacaaaaacgaaaaactacataaaaacattgtaacaaaaatggtataagaaaacatggcaaaagaaccaaataaatacaaattaaataagaaattacgcatttggggcaactttgaaactatttacacatctggggcaactggtcacgcccagaactgggcgtgacnnnnnnnnnnnnnnnnnnnnnnnnnnnnnnnnnnnnnnnnnnnnnnnnnnnnnnnnnnnnnnnnnnnnnnnnnnnctgggcgtgaccagttttgctcccatggtgacacgtggcacaaaaaatgggggtgcagggttttcgcggtattttcgtaaaattacggaaggcgataacttttgactgggacgtccgattgatgcgaaaccggtggtcatgcgctcgaaattgagaggagaagccgctggcaagttcccgaaggggacttgcccaaaactttttcccaaaagatgcctctaagtgtttcaaatttgcgttttaatcttcggagccctaaaaaatttttcgttttttgatattttatctattcaatcggtgaattgcaatccattctttgtttatctaattacttctcttaatttcgagcgctttgacataaaatacgtcatcatcggacattgatacgaaaaattacgactgttcaaagttatatgtatcgtcaaatctacattatatgagcatcacaatgtccttgtaaaaattctgacataaaatacgtcatcatcggacattggaaggacagtaataagaccaatgtcctcgctgatcacaattgttacaagtgctttggtgcattagtttcgccagttctagagagcagtttgcggggattaaaggattactctaaggattatgagcatgagatgatgaagaaggtgaagaagaagaatgaatcagaacactagggaaactggggaaagaagcaaaatgaagatcaaagcgtattttttaaacagtcgtaatttttcgtatcaatgtccgatgatgacgtattttatgtcaaagcgctcgaaattaagagaagtaattagataaacaaagaatggattgcaattcaccgattgaatagataaaatatcagaaaacgaaaaattttttagggctccgaagattaaaacgcaaatttgagacacttagaggcatcttttgggaaaaagttttgggcaagtccccttcgggaacttgccagcggcttctcctctcaatttcgagtgcatgaccaccggtttcgcatcaatcggacgtcccagtcaaaagttatcgccttccgtaattttacgaaaataccgcgaaaaccctgcacccccattttttgtgccacgtgtcaccatgggagcaaaactggtcacgcccagaactgggcatgactggtcacgcccagaaccaggcgtgactacccccctagtcacgcctggttctgggcgtgaccagtcatgcccagttctgggcgtgaccagttgccccagatgcgtaaatagtttcaaagttgccccaaatgcgtaatttcttatttaatttgtatttatttggttcttttgccaagaaaacatcaaatccctgcaagagatatgcgagaatttgtcaaacataaaaagcactggcattaactgagagaactcttttgttggagaattttgtaggtgttttcgaactccgttctattaaatgtataccacataaattagagaaattcttaggtgcacttgaagtaagatatttattactttgattcattcattgttcaccatgtcaacaatttacctagaaaaattaaaaattatcattaatttagaaagcaataatgactcacaatactgacatgacgaataatgaatggatcagaacaacaaaaacgtcttgctccagatgcacctaagaatttctccataaattatgtgaactgtaatgtagtattttgctttaactatattttaatgttatatctgaagcgaaacacatccagaacattatttggtgcacttgtacaccaaattcatcacctcacatgtattgatctatatatagtagctgaatctaagtatgtaaaaattaaagtggaaccagctatatgtagatataaagtattattataattattcatggaaatatgcttcctttccgtaatacttttacggtatcttttctttttcttttatttccagcttttcttaatgcatttttaatcatgaaggatcatttttgttccatctttcttgtttttattgtaagttatatgtgtatttgttaaaaaatcattattcacggggacgtaaaaggatatccgtttatacaatcattacaaagctggattcttttgcttataataatagaaaaagataacaatatccatatcaacagagaaaaatcacagtttttcgtatcttattttatatttaaaaatgtttactataaacaaaagatgttttttcgtatttggaagaaagcagatattcccattgttccttgcgaacaaataaatcacttgccacgcttctttctccattaataaaaaaatagcagaatgactttaatatatgttaaatttagagatgatccaccaccattcattttcggtaacattagccctaataatcccgagaagaattgtaacaaaggtacacaactttagtgtattaatattatacgcactcggttacaaaggcagcaaatagcacagtatccactttctgtttagaaatcaatcatttccgaagaaagcttatttcaaatcagaagcccagaaaattctccactttatttccgaagaatccactttttatttgtcttatcaataataggttattaagaaggtatcaatctcaagttcaaattggaataccatgcaaaaaaaagtttgacattcaaatcatgcctttgaattttatggtcacaactttcaactgaacgtacggcttaaacgaagtcagaaatttgatgaaatgaaatattattcaccttagctaatacttcagacagaaataaaaagaaaaaaattcaatcatgaaagatgatagctccctgaataactttgtccaaacgaagataacttcagacaaaaaatacacatacattctttctattacacaaacgaagataactttgtccaataatttatttattttaaactaaaaaaatgattgtccaaaatcatgaagagaaaattacgggtctgagattccctcacagatgtgaaaatctaaattttgtggccttgatgcatgaaacattcaagacccatgctaatcattacatatctaatacatgacctaattttcctatatctttcagggaatgtctctaccattaggtataccagtcctattttcttttacataatttctcaaaatgattgtttgattatcgaaacaaaatagagtattcttaaaaataaaacggatattcccctcaaatgatctataaaaaaaccctagttttcgtccgtataataatgtttatgatcccaactccataaaaaaaaagtttataattccaacatcttaaaagaatcatatatttttagtctttgataaatgatgaaaaactcaaatcacatcacttttataaatgcatagactaaaaacacgttaaatttttacaggaacttaaataaaatagggagatattttgagaaaacaaacatattttaccttttttaaaataataataaaaaaaaacgtagtcgaataaaaagtagcaaaactaattcggaactagcaatgaacacaccctgtatatcagatcatcatcaactatgttatggatctccaaagaaatgatcgtgaattcgtgattaccgttgcacgtaacacgaaagatttgttgaaaaaattccagattctgaaacaaagaatgtaacactgaaaacccaatcccaaatcccaacgcaatgcagattggacaagaagaagaagaagaagcaagcaagcagggaaagagtaattgattagaatgtaatttattctatgatctgattgccataatttttgtacaggaaagtaaaaaagaaagaaaaagagagagtaagttctaattgggggggtaagggtaagggtaagggtaagggtaagaagcagatccatgaagaaagcagaagcaccaaccagttttccagatcgtccaatgctatgacacagtaatggatccaaataacttacaacaacacaaccttccatccatccatccatctccatgcctatattataatatcactctacaacaccacaacacaatctaacaactttaattaattaagccagagatagtgaacaacaacaacaacaagaaaattatgattataccgacaagaggctcttcttcatcagaggcacagcgcggtggcggggagctcgtcgttttcgtaggcggcatcgggcggcaggaggtttagatcgaaaggaagcggttgccggaaggaggaggtgaggacgcagtcctggtcgtcgacgacggaggaagaagagtcgcaatcgctgtggcaatcgtcgtcgtcgtcgtccagagggatgatagggttaacaaccacaaggggcttgcgagaggaggaggagggaaccctaggcccactgaaggactccacggtgctgctcatgccgctgctggtgggccggttcacctgggcgggctcgaacttggtggaaagcccgtgggcctggtagagcggcggaatctgctgcgaggagtggtggtccgtcgggacggggaaagaggggaaattggtcttggccttgggcccgcggaaggatcgggctgccttgtcgtaggcccgcgcggcatcctcggcggaatcgaacgtccccagccacacgcgctgctttttccacggatctcgaatctccgccgcgaatcgcccccacggccgcttcctcacgccgcggaaccgcgtctccttcgcctgctccgccgtcatatccacgacggcggcggtggctctccctcggcgcatcttgatcacgatattaaaaaaatattatattttacaagaacaagatcgatcgagaacaagcaaggagacaccaccggcttcttcttcttcaaaccccaattcttaatcttattttttttccttcgtttaggtttggggtcccatgatgcggtctcgcctcgtttgctccaatagattgattatacgtgtgtggaatgacataattgcccttttgtcgttgtgtggggactatgccccttacgctagtgtgtgtttgaattttcagtgaacatccatttgcacacatccaagtccaccgaacggaaacgttccgtgagagaaaggattgagttgaaccccgttgaagggtttttaattaaaatccaaacatacttaatttttttaatcgattaagtaacaaaaaatcctttttttctttttctcgaatataacaagtaaattttaattacttatatcctgagattctcttaaaattattatttatttaatgaggttaacaaaatttttatgtctgatttaaacttcaaatgaaaaagtagtttaggggtttgggtatatgctttgtcgtcattattgttgttattgccttcgattccagaccaaaccaccataaatgggagcaaacgttactttgtggtatttgcgatttgccaaatgtaaattaacgttttttaacttgtcaacatgttacgctgagggttagattttctttgtaatagatgtaaattcatttgcatgattaattggtgaagtctcgttggattttcaaaacggtagaagctgctaactaattttcattaattcagcaatcgcaaaatccaactttgttgcttagttggttgaatttatttcatggtagagtaaaggcctgcttattacagtttttttatataaaaaataatactggtaactttgtttaataaagaactaaataatttatgttttgattgaaaatatgtttttttttaataaaatcaattactacttctttaagaaaatacttttacgattgtaaacaaatattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatatatgaatttggaaactaataaagcaagcgtagaaatatccaataacatggttttaattatagtatgtatgtttgtttcaagaaaaatatatagtctgtatgtttcagtaaaaaaaaaataattatagtgtgtaacttttattcggtaactgtaaattatccattacttatatcatgatttacaaactactataaatcataaaggatttgctatatataaaaaaagaaaagaagctgaaaagtgtctgaagtaatgtttcttatagtttacatgattacgagatttagttttccacacattaaattttcttgtggctgggtggagctggagactaaaataggttcaactgttgtatatacttttcaaatattagattatttatgctctggccaaaaagtattagatttgtctatactaaactttaagtcatgatatggatgaaagatagaatgttaaaatattgtttatagccaatgcctaaaataggagtctaaattataaataacaaacattattttatactgtaacatatataaacacgcgtagatttaaattgggtgttcataagaattatatataaataacaaacattaattacattattttatactataacataaacatgcgtacatttaaattgggtgatcataagaacaagcacatttaagtgccatatctaatcttaaaaattctagatattctcatttgcattcataaaatcccagaacaaacatccacctaaaatcttgaaatttatagtttgaagttatgtaagttgaattttagaagaacttgaactacattttgatacatttaaaccagtacggaagcacacttatgcctagttattggaagctaggctaaaaaacttacttgttaaatcaaattaaatatttcttcacccaaaaaaatgtattttttatgacaaatttatatttagacgtcaaatgattgatttgatatatttcttctacttgaaaaaagacgagggagacagggagttaattgaatccggttaggaacaccgatggaagtcggaaggcgttgcatttcataatttccattgtgtacacgattcaaatctcttgtcgtcaagcattgtggaatagttcataatgcgttaaccaaattctaagaagaaatattattttcaaaatgcttttatagttttctttttacaattggtattaaattagatgagatgtaatgggaatttcaaaaaaatatatatataaaaagattcttaaaacaatagaataataacaactaaaataatatatgaaaaaataacaatggacaagaaagaaatatcattaggtggaagaaatcataacattctctctctctctctctcctctataagattttctctcttttgcataatactactctgacaaccttaaaagagatattaattattatctcttaagtcaatttctacttcactttatgtcaattataagttattctcaaacataagccttagtaatgaatcaaaaaggatgaaaatgtgtcaattataagttattctcaaacataagccttagtaatgaatcaaaaaggatgaaaatgtgtcgagtactgtttgcattagctttgagaattcttatgtataagattaagacaatgagaatagtcatgacaggtcctggcagcattggaatgctcttgagaggatccttagaggaaacctcaaatgttgcattctgttttggaggaccaaaatttgttgtggaatattcggaacggaaatacgtgcatatttttttatatatccaagttagatacatttaccttgcaaattataactattaatatataattcataaatggttaattgattaataattaactatgattgataatgagttaatttatcggcctaactcgtcgaacttgaatgaatcgtgtttatgtaatattttttctatttggaacttgtaatgtaatgttatagtacatgtgttactcctccacgtcagtcttattactggagcatggatgtctccccttagcaattgggttgttgaactaaacgagttaatgttgcaacctacttatcaaatgacagatatttaattatttataagttatcgtattatcaacaagttacagattatctatcaagtatacatcatttgtaagctcaattatctataacctacaattatatgttagtcaataactacagataattatatacaatggttattatatcactgtaacaaccccgaaatacaagggttcgatgctccccttcattctataaatatcaggtttttgtctaaccctttcacacactaattcacactgagagacaattgcactcacactcttacatgaattaatacttaatttcgtatattcattcactcattcatacataattgatgtacttacttgagtatcagagtcttttcctttgttttgcatgtccctcctcttaacaaagtcgatttactgtcttacatgtaaagatctggaacctaccttaatcatgtccatcttgacatgcgctacatccagattttagtaataacaaaattataagagtgatttcaaaagggaaaatattgtatatgttgctaattcgagtgaatgtatgtgacattagttgactttcccccaccctgttttgatttatggatggtgatttggaacattcatgtcttttgtacttcttttttcccaagcatatgccaaatgagaaataaaaattatctattattatattataaaaatagatttcagcagtgaagtagtcccagatcaaatttcactcgattgaacttcatttggctgaaacttaggcttttttggttcaatgattaccatgtctcaagaagcccctttgtgaaatattgtagcgacccttctgaaaacgaagataaagtaatgggacaatatctaaaatagtaaaggggtgagatatctaagtttaaagtagaaaatcaaattaaaaactgtaatggttggtacatcaattaggcttttcatcgatctatcatagctaaagtggctaatacaagaatattctaaaacatattaaaatcgagagagcatatattgacaaacaagggaggtgtggggaagagaatggaataaaaaaaaaggacaaagtaatatggttggtattcaatttatataaactaatcaacacatgtttaaacttatgtttcacacgttaatatgttttttcatagacatcttacacaagaatcaaccctattcaataaacggttcgacactaaatgtatattctcattgtgcaaaactttgaaccgtaatctattattttgtaagaataagttccgtatactaaattcaacttcagatagttttatataaaatttgaacccaaacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaataaaaaacaggtatcaaaacaatttacatattttactcaatcgattgaactagatacttgggcctattctagaattctagaatttagattgcaaatttttttcagtccaaaggagtttaactttgtacgagtttcaagataaagccaaggcctattatcaattttcaattaaaaatctaagagactgatttaaaataacacaacaatgaattttagatttgcgtcctttgattttcttcaataacagaattatatcctggccatgagaaaagcagatacattttacaatgcaaaacacacacaagtggttgaaagatctcctaattatatataaaaatatcttgtttactaaaaaatatcaatcttactatttaagaaaaagagaatctaaatccattggaaaaccaccaccaataccgcccactgcgtaatgctcttggattccgtattcccttatttgtctcctcttcctttccatcctttttttcttcttcaaattggcattttgaaccatgccacagaagatttaaatcctctcatgttcttttcctaaattacgagataaaaagacaaaaataagtttaatagaccctactcacgtgataaataaattttcctatagttatttgtctttctagtttatactcacataaggaacatgaaagacccaaatggccaaatctgttgcaaagcacccgacattaacttgaatttccaaactccacatagccccaaattaaagtatttgaacctctaaattattattttttttaaaaaaaaattaatagttagttaggcacgcccttaaaaacggagttagcgacaagtttgtcatatttcccttaatttgtcatttagcatttttaaatgtgtaccaaaccaaccccgagagagagaaaatgaaaaatgtgaagggtcataatctttctacctgcactttattcaccacaaaaaatgccttccattcccccacaagccagtggttgtcacaacaacctctgaacaaactatccaactccacagaattgcaggtgaaaaggggggaatagatggtatgtattatatacttctcctgaaaatgtggggaaaactaaaatgtccaaaagaaagagaaaaaaattcaaacttcaagtagtttttagtcgtgtaatggctctgcagaagccgggaaggaatttgatgtagtatcatcttgtttggatgaatcttctgtagcagcttttgcatcagaatgctgaagcttgttgtcacttgataatttagaaggagatgtctcaggtgattgtacatttgataaccccctggtcagaggagtatcaagtacattcatagcaggtgaggtcaagccatagttctgcgggatagtcaaaactggatgatcaaatttgcatgttgggccaaacttgcacgttccatagattctgtaataatagcatacagcttgcccctgcagataaccaagataggaatcaggaatctaaatacttaaaaaaccatacatggtagccaatatgaactgtaaaattaccttcttaggattttagggaggacaatatgaagtttaagaataaacaatacatgttctgattttttccattgccatacaatcacaaactatcatgtatttcaagtccattgagttttataataattatcttaaaggtcgtatcttggattatttttcatggttgatggtgtaaaaacttttaaactaaccatgcatgtctattaaactcattggcatcaagtagaagctgaacttacaggtctcacaggaaggccgagtggatttattaatgattgagatattctttcctttgggtggtggaacttgcaatcggatccatatttgcaggtcccagtgctcataaagtatctacattctggttgatctggtctattcgggagagctgaattgattgcctgccaaccaaaaagtgactcacccagattcatgtagtcataaacaagattagatccaagtaaaccgttcggcattgcagggttcatatttccctattttgagaaacaaagtcacagtcaaaacaaaagatttcaatttgcagaaagtaccatgaactgcatgtactatgtagtaaccacaacccaacataattaattatcactaaaaggcgagatgctctgaagatttccttaagaacaaggcacattctgtatcagatattaattggtatatgtatgccaaatgtgcttggcaattaatgaaataaaatagatggaaagtgtaaggaataacagtatttccatacacagatcaattccctaaagttccttgcaatggtaacaatattttataatcttcatgcatttatttatctagacatatcagtcagacaacaaaattcacaatgcctccaagtaaagaactattgcctaacgcttcatgctgcgatccaaaactattatgtatggagtaacatttctgtaagacagcagaggagcagaatactatatcgaactccatctttttttccaaaaaattagcaaatctgtgtaacccttgcaatcattcatgaagagaaataataccactcagatcaaattcaatgacaggataaaccccgagcagaagagaaaaacaaagaccagagcaaacagcaaatgtatagatatacaggacattgaacacccttaactaaccatgtagttgttccagctctgcacaggtataacaccttgtgaagaagacagaaaaggaggcacatatgattgaaggccttgtccagataaatacggcattcttggtactgctgaccatgcaggaaaccctccagcatatggtaaacctgatgtaggaataattgttgaggtaggagtaggagatccaccagccaatgggtatgctccgagggaagcatgctgtggatgatgaaacttgcatgcaacaccaaacttacaagacccagttctcatgtaataggcacatgatttttcttcctaaacgagacatccaaagaatgttgaaaatttgcaatggtttctttcatcaacacagcaacagtaatcaattaaaaaaaatgctacaagtgcaaaagaatgcacaaacctgacgcatgggaagacctaaagtattgaatgacacgggagcagcacctcgcctatcctttggatgatgatatttacatgttgatccatacttgcacgtcccagtcttaagaaaatactgcaatgcatatttcaaaagagattacaagttactcaaattgaatagcactggaattgttaataaatctcccatgaagatggactctgtagcatacaaattttttcagattatactacagtttctgaatctgatatttatagtatagtagatgttaaacttaagttcatatacttatttcctttcctggtttaagtatgccatagctggcatcaaataaaattttgccatcatcatcataatgaaatctggtaaataagttctaaaggacaaaaaccacataatatgaccactaaaaataaaacaaatcatcaatagaaaacaaaatggtagcagttatacattgacagcataactactttatttttgtccagttcattaggtatcctacttcaatttggcattttctttcccttcatttattggtttgatatctgtgcactagtaatcactagctaaacatttcaaaaagaccagatttattgctaaaagggaccacaaaaaaggacaaacataaatgcaaaaaagcaagtaaagcttctgccagagtgacattgcaaaatatgaaacgcatatcttcttatggagtcttccacaaacacaagaaatgttacttttttattacaaaatctcccccaaaatttatgttaaagggaaacaaatatattttatttcactctaatattcttgcataaaacacatccccgatcagttttatgaagcataattctgttctgactcatgaaccaacaactatccaaagcttaagttgttaggtaaagacacatgaatggctttatattacatccctaataaaattcaacacaagaaaaatgtcacaaaaatacattttcattcatcaaaataaacatacctcgcaatcaggttgccctgccctctgagggagttcttcaccataatgagtaccctgaaaatctaataaagtatgagaaacttcaacaatttgtttgcatatgataaaactaataagcagattgaagattaagatacaatagaaacaaactaaaagattacaattacacaaactacatctttttgtcgaatatttggcaaaaagtgttgtttcatatatatatatatatatatatatatatatatatatatatatttatccagaagacaaagaatgaaaagtaaattaaagaagaagctcgtacagttgaaatatgagctgggtgatggtagcgacagctactcccataaccacacactccagtcctcaaataatataagcactcaggttcaccgtgtcgatctggatattgggtagattgagctgcagcatctctatcccaattatcattgattttcaaacgtcgaattgcttctacgatgcagatcaaaaccaatcaggcgaagtctgcccaaagtctcatttgaacaaattaatgcaacacaactaactagatcagaaacttaaaactttcacctcaaaaagcacactattgttgcctaagagattttaagatcaaaacatgcaggcgatccttagttgcatcattaaaaaaaagtgcatcaattatgtaaacccatgtatgatcaaacacaacacaacaccatagtttaggaagaaaaacacgaaacgagaaactaagccatgtttcccaaaaaaccctcataggtatctcacaatacattgtgtgaatcatgagaattctccaaatcaaaatcatcgtaccataaaaagaaaggcatgatatcataaatgaaacaaaaatcgttgagtaaaaaccatctaacatctaacattccctagcaaaacaacacaaagccatcatcaccaaacgatgatcggagccatttaaaccatgaatcatgacaaacaacaaaggaaaatcaatcaccagaaaaatctgcaccaccttcaatgttgtcaccagaatcagcattcctcggagcctgcctgctttccggcatctggtagagttgaaattataacaaaagactttttttttttttgcttgttcgatcaaacccaaaaaaccctttgagcctttaagaagaaatcagcgcacaacaatctcaaattaactcaccccacatggtaaaatgatcatcaggagaccgtgaaaattgaccaaagactaaaaaacaataaaactgaaataaaataaaataaaaaatcctggaaaactaaaatattaaaaacaaaacaaaggtacaaagcgagaatcacagataaaattgagaagaatcaaatgggaaatcttaaaaagagatttaataatattccaattggatgaaagttggcgtcacattcgattagagtttccttgctgtggttctgcaatcttcggaacattttggatctttgaatgtgaaacccgacaagttaatttataattactaataacgataattactatttggtgaatgattttatttttatccttaaattccattttaaatttcaattttttttctaatttatatatcaatttcctataacttttatatttttattttattttattgtttttattaactttattatttaaaaaatttaaagagtcatgtctctcttccccggcaataattattaatacgtacagtgtgtattcttgcgcgcgtgtacgaacaataaattctctgtaccatattaccctccacgtggctgctccataacatgtttacagagtttacgatatcctagatttattactgcccctacggcgcgtgcactgcaatcactactacaaatttggattgttaagaaaatttaattagcctgaaaaagtagatgccaattatggaattggtaagtggcattttaagtttttaacctcttgattttatctcacgagattaaccactttaattcctttcataaattgaggtctccatttttagcttcacattcaagcggtgataataattttgaaaagacaattaatatatgacaacaattaataataactattacatcaaatgattaaaaaaatctttcaaaaaacctaaattatcatgtaatattatcattcaagcgcgcaggaatcactactacataattatcataatcaaatattatcattataataataactatgaaaacgacaataatcataacaatcatgatgataataataattaatgataattttagagaaaaatcacgaaataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcgtattgtttgcaccacaatgctatttttctatataaaaaaaagtattattttttaaaagtaaatagtttataaagtaatcgtgtaaaacttttttgtattattgtccaaatacaaattaatattatataataaatttattaacttttattataattatagttattttcaaaaatagatctatcataatttttttattagttcacagtataaaacattttgtacttttacattaaactcgttttttaatatgaaggagccacaaagtatgacttttgagacacggagaacaaaaacatacaatattttattttgtaacgcactagcattatcacctgaataatgcacaagctattaacccaaaattggtaatttattttttaaaaacttttgatggttttaacgtaatctatcattttttttctggaaataatatatcctcataattaaaagtcatgatattaattattgagacataaaaatcatcaattggatttggtcttttttcataaaatattttcctgcctaatctatcatctaatgtatgtaagccgatattaaatattatacatagaaagcccgatattaaatatcaagtattaatattattattttaaatatattttnnnnnnnnnnatttttatctttaaccactaatactaaaatattatattaaaatctaatcaattcaaattaaattaataagagcaataaaatttctatcctaatttttagtataagtatgaatgggtgtggacatggataaaaataagtcagatgatctatcagagtctgtgttctaatatgtccaagttcaatgactgatttgtttattaaataggttagtcttaagttttctaaaaaaacctttttaactagacatgactaaacttttgacttcaaaaaaagtttttaaagcctgataaacaaatatatttatatatatatataagtatataatatttatatttaatatatattaatattatcattaataataagattttataaatttggttgtctatttaagtttgttgatttacttagtcgacaaaaaagtttttaaagcctgataaacaaatatatttaatatatattaatattatcattaatatatataagtatataatatttaagtttttgtgaacatgtgggcatgtgttttctttgttgacaaaaaagatatatttgtggagataacctaaaaaataatgaccattgttaggaggaaatattctactatctaaataaatttctgaaagaagtttaagaatttcgatgatcgattaaaatactcttttgcaataatgcagaacaaaacctaaaataaagaagtgagtgaccctattgggaataactcaagtcacacatcgactagaaatagtgccaagtcagagtatataagttgagaacaatcctcaccctatgagctagttttggggttgagttaggtcaaaacccacattctaatatggtatcagagcctatcctagattcattaacgggtcacccaccatgttattcacgtaccaagcccaaaaaatgctggacgtgagggagtgtattgggaataactcaagttccacatcggctagagatagtgccaagtcaaagtatataagtggagaacaatcctcaccctatgagctagcttttggggttgaattaggtcaaaatccacattctaatagacactaataaaaaaacagatttttgagtatttaaacttatatattataaaaacaaattaataattaacaaacaaataagatgaaacttgcataataattttgttattctttttatttattaataataacttagagactcctcaattcttttatagtaagataatcggtgttgagagtagtattaaataaataagttaaaacattttataatattataattcttttcatacatatattctttagactacaaacatttttgttggaaacaatcttacttaagttagatgtgaccactatagtaacttgtgcatatgtatatttagtcttaaaaaaaaatcatgatttttcgttttaatttctgggaaaaaaattagatttagttcttagatttaacaaaagaatatgattttatccttatttggttacgagagaaatggaatgggaggagaggaggagatgatggaaataatataactctagtgggagttagcatttcaaagtttattgaattatttcaaataacaaatatgatatgaaagataggaaagtgtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtattatttctaacatatttttacttatatttttacccctctcccagtatcttcttctctattttttaaaaccaaatattaataattttcactttatttcttatctatttttgcttatttttcttattttcatttatcctatttctttcatttaccaaaaagagcattactcttttggtataaaactaaaagtattttgttttattaaatgtaagcactaaaaataaacaatttattaaaatacaaaatcatgatattttaaaaattaaaagcatgtttaatctttaattaaatataatttatcatttaataaaattactcctgttggattttattaaactataaaatgatcatttttattataattttttatttataaaaataatttattaaataatttataatatttcaaacatcttatttaactaattaaattataacaggtttgtaaactcattttatcttattggctacgtttcaagggacaatttgttgaaaagtaacattttcttacttttaaatcaacgtacttttgagggatggagaatgggtgggggggaaccaaacgcactattagacttcttggtattttattgcagtttacaaactatattatattgtatagaataaattgtgaaattgtatctgttgattcaaaagatcgaaagataaatttttgtaataattttagctaaaaaaattatcattaaaagttaataatcttttttaaaaatatgccctttgcttgcattttgacttttagattttgccgacgcccaacagttggtggtcaattttaacattttgtgttttggttaaacccacatattcgttggcaggaaggacacttcatatagttcagacattgccataatcatgcattcaccaaaaacaaacaaaatcaaatgtattaattaagagaaatgttagtactatgttatatgatacttttttcctaagattctttttatatgataagataattttttttgaaaaattataattttttataagttttatttgttatttgatgatttttcctgatttatattaaataagattttctttttatcaaaattaataattttttataaattataaccaatcatataaaaagttttggagaaaaagtgtcataaagaatgtcactaataatcctcattaattaattattaaagaaaaataaaatagaagacgtcaattttctttctgttaatgagaggagattttggaagatcttgaccgtccagttgcgaggaagaggacttcgccttctgattcaagttatgtacgatgcattcgtgtaaaactgtgaaataatctagggttgaaaagtcatttcacacagtgccataaggcatataaacccagaatgcagcattgacgtatcggtgttgcgaaaaatcgtcgccgttaaagtgatatagaaagctaagcttggatacgcggcacgtggaaatgaatcagccattgattgcaaaagtcagtggtaggcccatcgtttcttcatgtcggcaattgtattttgatttaaattcttaaatggatgaagcatgcgattttgcatcatcaatacacatatgatgtaataataaattaataataatcaatcattaatatttttcattaaatatttattttcttataactatcagattatatcagtaccaaaaaaatacaagcatttattatataatctcaattgtaacttcactatttctatatcagttaatatgatattttttcaattaatgcatgattttttcagtttaattaataatttaaaatttaaatattatttaaattaaatatttagaaaaaatattacttataataattctaacctattggaataagattgttttcggtagaaaatatctgtatctttattaaaacattacaattcgacaacaatataagaaaatattacattgtatttaattaatgctatatatacaaattagtaaaagcatttaaaataatgataaatgtattactcgttttttcatgttctccttgggataaaaaggcttcatggtcgtgaatcaaaacggcttacaacaaagtggacgaggatttcgtgaagggaaacactagaattagtggggctagatagaaaccttacatatttaattaaccaatgcatatgctcggttattatggttataaatatgattggctctctctcaacaaaattctgcctttcaagaggaattatataaggggatcaaatgatcatacataggtctatttgtttgggctagcaaggaaactagaaagaataagctactatatactgaagatggggttgcctctaatgattagcgtggtccaaatttatcccaattgttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttctcaaactaattcaagaaaaaaataataaattattttataaaattaattcaattaattaaattatttttataaatttgattcgattaacttaactaattctcatttgaatattttttatttgaaaaaaatagtttaaaaatcactttgagactaatctaatttttagaactaatttaaaactagttaaaaattaatttagttcagaattaattttttaaaactagttcgattctgaaccagtttcaaaatcaatttgattgtttgaatacaaaattaaatcggttaaaacagtttaaaatcagttggatttttgttttttttacacccctatccttgtgggagtaggcatcaaccaacaagcacacgtcattaacaacattcttcaccatttttgttcatcctctattaagagagttaggttgcctacatataaagttttgcatgcatgttctcaaataatgtgagccagcatgaaacaattgttgttaatgtgtgtattgatcaccaatgatataggtcaatattttgggagttcatatccttcatttcttttttaattgacagtttaaaaagtttactattgaaaagtcaaagcctcatcctttgttggcaagacaatacaattgcttaatccctcttatgagggttcccgaaaatatcatgcaaactatatatatatatatatatatatatatatatatatatatataagattcctataagtatctgtcaatcatgagagaacatttgtaaacttgaggagagtgcagctcttggatatagaaacgtaaaactaaaaactcttccatcgtgtcttggaaactttctcacaaatgatgaaggtaggcatagaattggatgtcttttccccatatgccatcttttgcgtgattgtgaagatgttgcagccttgcggaccagccttaatgcttctcagcaatgtagctcattctttactgcgtcggtttagatgcttgattgtccaaaatctacgaagagagtatcttatataaactataaaaagtgactcaatttaattatgttaagttaaattcgttatcgttaactgtgtgtatttggtttcatgttataaaatttattttaaatttataattaatattaaatatatttttatacgtatgattttatatcaaaaaatagttcaaaattagttttagatctaaatttgattataaatttaaataactttaaaaaaatttatgttagatacaaaattttgtattgaattttatttttgacttagttttacaaaaaagactacaaatatttaaacataaattacgctatttcaaaattaatttaaccaaaattaatttttccaaacactgttcaaactcactttcttatgtgacacgtttttacgcatacggaccgacagtcattttggtccttatgatgcttaaccttaatcactttactgacatttaaatttaattattatttgttgttattttaataattaaaattaattatttattattattttgatctttaataatatttttaaaatgaatatttatttattaagagattctagttcatttaattggatagaatgtataaattattataaatcttctaacattatttttaatttatatgaataaaaaatagatatttaacctaaacttgacattataaaattaaattttaattttatttaattaataaattttaaattgagattttagattaatttttggtggattttataatatcagataggatttaagaatttttaattttttttatttttttttatgatagatcttattttatcatattagaaaaaaaagaaaagaaaaaaattattattttttaaataatatatatatatatatattttaaaaaaatctacaaaaatctatctcttttatttagatatttaataaaaataagatgttaaacttgagatttctatagtggaatggaggaagtaggattgttgaacgaaatgatgtggtagtgaatgaaagtgggtcccagtggaaaagtgggcagtgaggcgcgaagaaggaggcaggaggcgacgtagctttcagtctcacagcagacaatgtaagatttggtggttctgcgctacgtgggagcaatagaagactgaaacgtgtcctcgatatgtaaagttgaatcaggtgttcttcagcaacagtaaaaagatgaatgccactgtaactccaatctttttgcccaactcaacaaactttatgatctacactgtagagtagactagtccatagactagcttcttccatgtgtcgcacttcaagattgccacgattaacgatgcaccattccatttttttatatcttatccttctttccatagaaatatatatttattcatttcgtacaattcaattcataattatacgtttaagttggttaagtttatgagacacaatttagtttactctccatataatatactttttaggaaaaattatcaattttaaatttgattcaatttggattaagaattagtctcataataaattcaaatgattgaagcttataaaaatattctgaaatatcactaaaacacctaaggtcagtggtgccaaataaaaaaaaatatttacttcatttcattttaaattaaataaatggtgaacactaaactatatttggattcctcaaatgcattaaattaatatattggagtaaaattttctaaaaattaaaaagctaagcgtaaaaacatgtaaggaattgaaaaataagcatgtggaggattttatttttagataaattcagtacatgtttaaaaattaggtggaaaaatacttttatacaaaaggattaaaatccatatttttatttttatcttataaattatattgaaataccaatgatacacttccatgactcaattgaaagtgctttagccgtacgtcttggttttttttttttagctaaagggaaactataaagtataaataattaatgatgtttttcttcggtgctcgaaggttgaagttagatactactgttactgtaacacgcacgcacacacacaggaccacggaagtcaaatagaaattacaaaatttcgtttgaatatttgtattctttacttttataatttcaatcctttattaattcgctatttagtggatggttgcaaaccgagtctatactaaaaataaatagaaaccgacatggagactcttatacgacaagcatgataaacaataagttagttcttattatttatttgattcaaagaatgcagttcacaatgggtcaaggaacctgctgatgcaaactaatgaaacattaaggtcaagtaaattagcagcattttcaagcaggaggtaaaatgtcacattcacgagtgtatagtattcttctatgatttgccattaatttatacgttactaataattatttaaagagtttaatcgtgatagcataaaattgtattatattgtcactaatcacatattattgttgaaatgatatgaattttaaaataattattaaaaaagttaataaatttactatgattaaatgtcactataaagtaattttatactattattactaattttttttactctcttatctaaaaagttttaatattctaattttctaaaattaaaatagctttataacctactatcttttgccaatcctagctagagatgcctctctcactccaaaagtaagtgtacattacatagttaaccaaaggggagcacctaatcatttttagttcactactgaaattcattctaaatgttgttgctatgttgaaaaggagataaagattggttgacatctacaagggtgtgtatacacgtgctagaggtaaataaaaataaatattgtgaatgatgtgatgaaaaatacgagacataaagatatatggtatatgcaaagtttaggggtataactgtattatatataagaaaataactttgttgcaaaagaagttgattttctacaaactgctttatttccggctgtaaacacctttctcgccacatattttacaaacatttcttagtttctcagtcctcacctttccagccagaaaacgtgattgcaatttttttttttattagaaggattttgaatctttttataaacatactgatgatcaaagcaaaaagagtgtgtttgtttaggtacacattgaatgagagtaaaggaaatggaaatgaaagaaatgaatatttttaacttcttgaattggatcttttggaagtgaccagttgtcgattatttttttaatgaaaaaataattttcccttaaaatatttcacatggttgtttgtatcacaaataagagaatattagattaatatacttttttcttttcctccaattcaatattggaaacaacacttaattaaaaacgaaccataaatgaattaactataatttctaacttttggtaatacgttctcaaatagaatacccatgattctcttcctcataatatccgatattggaatccagaaagaaattatgtaaagagatttattttcattcccattagacaaccatcaaatgaggtcaaacaaggaataaaattcgacataagaattttcaatgtatcaagcaaaggtagatatggtcaaatagtcaatgaaaggtagatatatattccacacttgaggaaattccctagtccatgcactcgagtaacttgcatatgttcacttcataagaaaatgtagcaataaacttgaacctacaataatattttaaaagtgtgtttgaataaatttccttataagaatttattggagaagaaaatacgaaagaaaaataaattaattttttttttacaatttaaaattaatttatgcataacttaaaattcaaacataccgtgagtaatgtttaatttaattaattactatagtattgcttaagaaaatacttttttcctcaacaggtagataatactttttagtgtagtttatagtcgtagcattgctaatgcaatctagttggaatcacgtgtgctttgatctagtttttacatgtcctctttttgcttaaaacaaatttaatcagctgaaaagaatttgttcacctttgactatgaaggaggaaaccattaatatcaataccatgaaaattacacttaaagtactagccggcttcaaatcaccaatatgcttaccattacgaaggagtagcttgtatgcaataaactttgaataacatttcaaccaaaagtaatgaactttgaatgacatacatgtaatgtaaattgtaaccacaaacttgaagtagaatatgtgcatgatgagtagtaatagtcattgactttgaaggcctggtggggtcatggaattataaaagctcccggcggcgtcctcgatggtcaaactttgccctagaaatccaaaggcttagcaaaatcaacaacttggtcatgaccaatcttagtgaaagagaaaggcattcactgttcatggaaaagtgtcaccattgagaataagacgagtatattttgcaagtatttttgattaatctttcggcactaaaactattgatgtttaaggttaatacacatatcttaataaatatgaatagtactaagaaattttatatttagtctaaaatgcaatcatttaataatttttttgaatataattatatttttgagtaattataatttagtttaatatgttattttcttatgtctagtatggtaaaaggaaaagtaaaagagaaagctttaaggtgtgtttggtttggtagacggaaacaacagccggacgacagaaatgggggaagggagtttggtgtgtgtgattttgatagaaattaagttccggtgtattaaattttctattcattaaacaactttataatatatttttttttaaaacaaacaacataacatattattttatttctattttttaatatctcttctattttcgtttattctatttttctcttctaaaactctgagatatgaaaaaataataaacaaataaaaaaaagaagcaagagaaaagcacatgacgagtacaaacaaaatggagattgctaacactagagtccaactactcaacgctcttgaaaataggcccaaccaaatggtccacatattaggctacgttcaacaatcaaaggggtatcccaaatagagtttataaatcaaggagaagattttcaaattaattcaatgagtaaagcagttgcaaaattcatagtgaagaaaaatttaaaactgaagtagtttctataactgcttgaaagaccatcagcttataaaagaaaacttaaaatacagtcaaataaacaaaaaaacctgaaaacggaccaacggttttaaattatacattattaagttaatatatgcaataatatataacctcgtgatttcttgaatgagtcatgaatatatttacattgcgaattttttttgtaaaagaagcataagccaacattaagaaaatagcaaactgaagcaaaaactacatagattttagacattcccatccaacacacaagtgtatatatatatatatatatatatatatacacacacacttatggaagttttcaaatcacacttgttctttatctacctttgtatccattttcatgtcataaagtaattttttaacacgtacagtgctcaatggcaagtaaagtaaccactcctactatactaaattccttattaaaaaaggatttaccacttagcagaaaacaaaccaaaacatcattgcaacttgaaatatgaacaataaatattcaaataagattttaggccaaattcaactgcactggagaacagataatgcgcatccatgacctggtacttctgctgagaacatattatttgttcgtatggttcttccactccacatttcatttccagaacaaagtataaactttcttctacctggatgcactatagccaagtcttttatgcttgcagatattgttgttttctcgttactcagattgaaaaatgcaacataggtctcccctgaacggaagcaaaagcaacaacatggagaattagaggatagtgcactataagaaatcatggttaattaactgtgccatgttattttagttcatctcaatttggtagtaaagaaataaaggattaaattagaaaatagagaaatatcaaaccttttcttccagttgcaatccaagatcgaatccgattaggataaccttcagctgcatgattggtgaagttgcattactagataacaacataaataaactagaaatagcattaatgattctgcatagagataactttttgttactaatttttacctagggcatgttctactattgcacacatgccagaatgaccattaactagagtcccattagatttcaacttccatatctgttcagattggatagatgtctgctttctgcatcagcagcaatgtaatatggtttagtacaaataacaagaacatatctagacaaataaattggagaaattacgatgattttacaatgatgccgtggggagttctctcttgtgcacacagaaaggttcctcctgatcatgctttggactcttgtaacaaattctttcaagatcttggtaatatttttcactagaccatccatatgcttttggatcagtgcattcaatgagagccatggagtaagtaaactgtacttttgtgacattgtgtcttttagtctttacatcatttaatcttgtgatatgagaaaactatatagcaaaaaaggcagaaataatgcaaatctcatatttaagcgtctgtttgggtgtaagtttctctataagcacttctaaaaaaaagaaaaaaatgaaataagtttatccataaactataataaattttccattaaagtatgtttggatgaagtattttaaaatttcaggaaatttaaaattcagggaaattaaaatgcatcaattaaaattcttttattttttaaattttgtgtttagataacgaaattaaatttctttatttttaaaattttgtgttcagataaaaaaattgaatttcttcatttttaaaattttgaacctcatgcacggagaggcgcgtgagatgggtgtcgtgggagtagcggaggtcggagtattcaccgacgatggagacggaacaaagagtggtgcgattagagtttctatagaagaagagaatttcaatttctcaccttttagaaggaaattcaaattccacatttttagttatttaaaattctgttttaaaatttcaaaaatttaaattcttcatataaaaatatccaaacaatgaattttaaattaaagaattttaaattcgcttgataaattactttttctaattaaaattctctatccaaacatactcttagttaatttgtagatgtcatctcatcttttagagaagctatgttggtggacttctaaaaattagctaattgagagcttatttttgcttatggaaaaatttatctcattttttcttcttattttcttcttttagaagtgcttctagagaagtttacccaaacagacctacctaacatatggttaccaaaagaaaaagcaagaagaaagagaagtttcacatgcctcttgattatttgagctaaaagagtttatctccaatatggtaggatttttgataagatcataggtccatgcatcaatctaccgtagatcccctccatacataatgggagactttgccttacaccacaaagtcatctatgagatgagagtaacttcacttagaatctattgatttacatgggtatatgtcctctccaatttatagtaatgcaattcagttgtgtgtttgtgcatcagtgcatatgtaccttagttctttgctcatcttgagtaagcctagtaatcctgtatgaaccttcatgaacatctatcgagaaaaaaaaaccataaaaaaacataaaaataaagttttattctttatattcctaaacatctcaaattcaaacaaactcgttgcaattatgtatatgtacgatgtatagggatgaaactgaaaaaatatttttcttttttctaatgatttagaaagtaaaaggcatactttttttggtgaaaaaaaatacggaatatggtggctactctattcagtgactaaagcaacacaaatcaaacataaattaaaacattagaagctaagtgttctgaaccttacctactgaaccaaccccattggaactcggtaggaaaatggcatattttttaaaagtattatgcattggatgtaaattgggaactgtttagaataccttaactatcttggtcctaataaattaaggaaaaaagtagtaatgcaggggcatttaggctaacctggatcagttagccatccaaatggtagcatgtccaaatcaggtcaagattttccctttaaaccttttcctcctattaaattagatgcagcgaaatctctgaaagagtgaaagacaaatcagagatgtagataatttgaaggtagagtagcagaagaaaggtggaagggcactccacatattttgatatcaaacataggaaggatttaattaatgaccttactatattaaaatgagctacaattgctgaccattcatcccaatcatctcctgttacacggtatgtgttaactagattactaaccatcttagccatttgtggtgttgcactgactccaggagacagagaaagtacaatgcgtttgttaagtccatcgagaatctgcatagatggtaactcaaatgatgactaagttttccatgtattacctttaaaatgaaaaggcagaaaggggtgtgaattttgcagtaaacctctgatacagatgttatttcacccaaatccaagttattaccaaatacacagtcaagtttcactgtaagaaatcaaagcagaaaatttataaaaatgtgtcaaagctggaagtaaaatatacccacaattgcttattgcttatttaaaaacattatgattgaggtctaacgtaagaaatgaatgtattgcatattttgcaatagtagatgataagaagaatatacattagtagtgtgaataccaaaatcaactcctcatgaagcatacagctcatagattgatcttaagaaggcttttcgagctcctgtttttgtatttatagccatgaaaccgttactcatccatttacaagcccttgatgggattcctatgtctcttgctttccatactcgaccagataccatgtaaggttgtccctagcaaggtgcaagaacacaaaaataagttcaagaaaaaataacgggtatgcagttcaccaatagcctctattttcgagcaaatatatgcatttccttgcttcttatctatagataataaactcactttacagcatgattactcttattatattttcttcttctggtaattattttttgagttaccatgttatttatgtaaagtattcatccgctttatagatgattaacttctgtcgattacctattgaccaacttatgtgaaatatctttttaaccatgtttttttcaccaataagattcaaccccaaccttgcttgaaggatctaacaacatgttacttgtaatacattttttaactatataaatttcacctttattttttatcaatctatattgaaggaattagaaaatgtaccgtttgtgtatcaagtattggtgtgttgttattgaatgcctgtgtactgattccagccataagatgaatcccaaacttcaaacccgtactatgtactttattacctacatcagtgaaccctctccctcctcttgaagaaggccatctttcagggtcagggagcattcgtccccatttatcaatcacatcaaaaccaaaagaatttctatcaccctttagactcctataccagaggtaatccacaacagcatactgcattgtttcaaaggaaatattttatatatatgcatatatttaattactaacatattcaatagcagtagtccaatacagtacctgatatccatgagcaagtaaccactgagaaaatatattacattctgtaagtattcttcttcagaaattatccagttaaagctatcataggagttccagcctcttggaggcatgatagtattttatgatgacacactgatatcaacaaccatgaggtcaaatattcattgtttgcttgcatagttgaatatataccaataaatttcgtaaaaaggatattacgaaatagatatgaagactcagaaataacatcatgttggtcagtgtttacgtatgtgtaattcctctcatgactaatgagtaatgataatgaatgaccaaataacagaacaaggttgcaacataaaaagtggtgtccaaaagatcatggaactctctttttagtttatttaagatttaagacgacggattaatattttttttttcctactctaattaatagtcatatttttcaataaaatgccgtgaactaacaaactaattaaacaaagagagattcctatatctagctaattacttttttcttcatatataatgtttatttttaatttgatctctgcaaaaaaatggtctatatgtatataattattttcaattccatcgtcaccagttgttattataacattgctagattggtatggaaatataagaagcgaattttttataacatttatttttattttagttataatactttgttgcgttttaaccccaatacaaggtgttttgaaaatggttgtatgcatgtgagtgtgtgtactactaaacagataataaacttgtctaaacgaagaacatgagaaaataaaatgattcctttagtaggaaaatatattttattttcatttctatttttttttattaagaaatataagagacgtgtcattttattttttattttaaaagatttatacaaaaattaatcataattgatttctgtcgcttcttttacaaatttaaatttaaaaaagtaatcttttcataattatcaataaaaaaatctcaaattgaccggagcctaatttttttcccttgtcattacataagataaaagaaatagttaaaataaactgattaattaagttcctctgtatagaacaaaaacaacaatacgttttttttttcttctccgataaacaaatagtaagaatacacagattaagtcctcctcattataaaacaaaaacaaacttgttcaaaactaaacatacccattattgcaatgtttttttctctgtcttcaagaaaacatatatgcatctgaaaatcaattattgaaaccaaaagcaagagaatatgatgctgaaataccttcgaattgcacaaagacaaagaaggaagcaaacagaggtaactgagatgcacttcatggttgcagctaactctattccaaccatcaattatgattcttaacaggggattctagtatatataaacattgcctttgcctttgtgcaagcaaaatagaagttcatgttccttttatttgattcataacgagtttgtactagttgcgggccccgactcacatacaccactacattttgagtaacgaaggaagcatcaagtctatcttgattcatgctagaggacatgtaattttttttaatagacagatcataaaattttagctattttttttataaatacgcatgcatgataagactaaggaagtgaatcaatgagccttaatttctttatccccaccttaatatatatggaaattttatgcgacaagagaattgcattagttatgctttggatcactcaagataaagaaattagaaagtgttggcaaatttaaatgaacaacgactttccacctttgattcgttaattcggattactctccactgaaaattacttagtatcaattctattatttgaaaaattaaaaaatgacattttatgtaatgagttctgctatatggtacgaaatcttaaaccacgaaatgcacgaaacactgaaaacagatcatgtgtaattatcttataagaaaataaattaaaatgttcaaaaattaagtaatactgaaacagaaacatcgtttataactaaatcccgttaatcctgaaaattaccgcaccaaatttgaaataaacaaaagtcaaataataattgctccaccgaaattcaagttgtgaacgtgttgcaacaagaaggcttatatgttgtaaaggttattgggtttaaacgtgttgtgcctttgatatcaaaatggctaattatcttcaaaaataaaataaaattggtgcaatgcttatctttgatttggatagtagtacatttgatgtcttgatattaacaaccgctgagacgtttggaattaaaatcatagaaaacatgaagtccatgtccttcatgtgtttagtacgaatttttattcgtactcaacaacattttccttatgtaatactgtatataattgtttttcctacatatttttcattttttatacagacatctcaaaattagaatacactcaaaataaaaaggaattgcatttttttttaaatagattgattaaatataacgactacaatttcttgcccataatagatcactcatattcacttatcactgtggtcttatttattttcttatttgttttgaaaaagagtttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttttgttaaaaatttattattacatgcaaaatattcattaattttattaataattaataaatttaacttatcacttttaatacttatattttcttaacaacattttttccatctgaaaaattcaaattcagaaatttatttagaaaatacaatttggctaaacaaataaatgttcaatatgttacgtgtgaatcaattaatgtaaattgatttaacttaatcaataattttacaacaattatactaactgtattaaatatttaatagaagaactttaacactggtaatactaataattgtgtgaaagtttgaacagccatacctcttatttagaagtatagctttaaagtctttaacacatatattatatagcaatttttccaagtttaaatgggattgtcttggtaaattatacgtgtgatttgtaacaaaaatatataaaaaaaaatgttaatatattccttgacactagaggttggtgttgtgtgacgtggcttatagcatcatgctgcaagagtatcagtcacgtggagttctctcgccctcccatcacttcagtcgtgggccccacgctctttctccctccctcaaatctcaaagaggaagagccacacgctgtgccccttctctctctctctctccaaaatcccaaaaccgaagcaaaaaccgccttcacattcacaaccacacctccgcgatataaaaaaggtaacctccctcagtccctcgctcatggaagagctctccgcggggcctctcgtccccgccgtcgtgaaaccggaagcgtccaaaggcgccgcccccgacacagacgcttccgccgcggcctccggcggcatgttcccggcctccgcgtcggagccggacaaggacttcctctgcccgatttgcatgcagatcatcaaggacgcgttcctcaccgcgtgcggccacagcttctgctacatgtgcatcatcacgcacctccgcaacaagagcgattgcccttgctgcggccactacctcaccaacaccaacctcttccctaacttcttgctcgacaaggttcgccttcctttgctctcatcatcatcatctccatttattttactattccacaatgctccttttgcagtaaaacttgaattcagttcttgcttctgaatttttcgtaaacgctgcgtttaatagaacagtcgtttagtttttgtggaatgtatgtagcgaatgaatgctgtttcgattctctagatctttgttttcgcactgtaattagtaactgccccttcttgcaatgttgctgacttaaacgtcatagtttttagagtgtgtgctttgctctaatagttcttatgcgattccgcaatgctcgttttgcagtaaaacatgaattcaattttcacttgcgagttttgtttagtttttgtggagtgtgtgtggcgtatgaatgctgtttcgagtctcagatctttcttttggcactcgtaactgctaattgctccttgcaatgctgctgacttaaatgtagtagtttttagtgagagattcgagcatgatttttatcttggaaatgcagcttattgttatacggtttctgtatcacatttgtagctactgaagaagacttctgtgcgtcaaatatcaaaaaccgcttcacctttggaacatttccggcaggcattgcaaaaggttggttgtgctctcgctttctcttgattaaaatttgtctattggtagccatgttaattgtgcaatagtaagaggtctttgttgcatcttactttttatgttctgttatattatgaatataagtctagaggaaagtttatagtatgtttataaatttcttttttggactatctaataacatagtagcatatggaagaggattagagggtaactggagctggttttaacattcgttatgttatacaattcttgcatatttattgtatacgccactagatcaaggaccaaattatcggttttaactcttgtcattttattgtctaatattatattttatgtaagggttttaatcaagttgtggattcagttgtatattggttttactggaattcatactactttagtatattgaggatcactctattgtcacatatttccgtttcacgtgaaactgtggatctgtgttgactgttgatgctatttagtctgtgattcctttttctgtttttaatgttttgagttttggtacagggttgtgatgtgtcaattaaggagctagacacccttttgtcacttcttgctgagaagaaaagaaaaatggaacaagaagaagctgagagaaatatgcaaatattgttagacttcttgcattgcttacgcaagcaaaaagttgatgatttgaaggaggtgtgcttgctgcaatctctctctccctctactctaaactattgctaagtagctaatgtttccctttttttttctttcctctgtttgcagtagttggtcattatttactactgatttccatgttacatttatttttacttattgcaacaattggtgtttcatactttcatttgtaggtacaaactgatctccagtttgtaaaagaggacattaatgctgtggagaaacatagaatggatttgtatcgtgcacgggacaggtactctgtaaaattacggatgcttgatgattctggtggaagaaaatcatggcattcatcaatggacaagaacaacagtggccttatatctagccctctaaatcttcgtggagggttgtcatcaggaagtcatactaagaaaaatgatggaaagtcccaaattagctctcacgggcatggagttcagagaagggatgccatcactggatccgattcacaatatataaatcaatcgggtctttctctagttagaaagaagagggtgcatacacaggttttcttggtttaaatttccatgtttgaaattttatatttctattttatttctaagtgtattggtttggaaattttaatgtctttttggaaaagctttttgtcatagaagataattttgtttcatgccaggaaaagcaattgtagttctggaataagtttaaaaatttctacttaggaatttttctaaaaattgaaattaatttatattttttagggaatccttatttatacctgcataagtagttctgcactttttcatacactaatccctttcaattgtgcatttaatacttttgaagtattaccggttaatcaacacattttgagctaagacacttccttttttatttatttatttattttgtggtcattttatgttgccacaagcttcaggattcatgtggctatagcacatcttaggagagacttagacttaaatcccaagctaaaataagttagtggacataagaaaaggtagaaaatcctggttttttaattttttaagctgtatgttaggtagtgatttgggatggctgtggacagcaactttattgtttgagcaaaggcaaggaaaaatataaaaatgaatagtttaaaaaaacatgtatgtgacattatacacaaaagtagttaccactagatcaacacagctatgtactcaccatagtatgtatgtatgtaatcactaatatctgacattattaagaaaagtagttactactgtattaacaaaagatatctaaccctatcctagggttccagggcttcctgctttttgaatctctctttgaagttctttcatctctccttgaatcctgttgtccctcctttgaatcttgcggttctttttttcaaggagggacaaaaggatttcaaggagagatacaaggatttcaaagagagatgaaacgattcaaaagttgcaggaggcactggaaccctgagttagggttagttttcttttgttagtacagtgataactacttttcttaataatgtcagatattaatgatttcatacatactgtggtgagtacatagctgtgttgatacagtggtaactaattttgtgtataatgttagatacatgtttctttagaaacacttctaaaagaagaagaaaaaaatgaaatgagctttttcttaagctaaagttagcaaatttgtagaagatctctcatatagcttctctaaaagatgagatgatatctacaaattagctaacagttatctaatggagagctaattttagcttatgcagaagttcatttttttcttctcctagaagtgcttttagagaagcttacccgaataggcccattgaggcaagctaaatgtgttatgaaattctcattgagttgtgtatttaatacattaaggacattgtctctttaaaacccttgcaggcttagtttctgccactataattaaaattaactaattaagacacaaatatcaatatatcataataaaatttcttgtgacccaaagttacaattgaatccctattagaatgaatatcttatcaatcatagaaactacaaattaactatgaaacaaaaaatgccttaaaaaaattagctgagtagcagatgccatattgcttatgaaaaacaagacttgtatcaaaactagattctgtttttttatttttctttgtttttatgttttatttattattgtcttgtaatttaagtctgaattttgtaaagaaattttggcatatgccatatgctggcttttattttttctgtcactgagtttgcatctataaacttggtttattttgtcctctctgactcctgtttgattcccttcctttgctccagttcaatgacctacaagaatgttacctacaaaagcgacgacatgccgctgataggccccatagccaacaagaaagagatataaatctcataagtcgagaaggttatactgctggtcttgaagattttcagtcagtcttggcaactttcacacgctacaggtatagttgtcagtctttttctgccatttcaaatatccattcaaatatttttaggacatgggggtattttcccggaagaatgaatgggagtcaaattagctaggaaccgttagactgtatgaggaggttcaattagatgaataggggaaaataaggtcgaaaggaggcatttaggaaattgtattttatattaactgatcaagctctccttgctctgttcaattttagtctataaataatcattcttttcttttatccctttccattgggattcttaacagacttacaggtaatagtgtcagttattatttttttgagtaagcaatatacagttatctctaaccttttttcttcatttgaaacagccgattgagagtcattgcagaactaagacatggggatatatttcattcagcaaatatagtgtcaaggtgagtttgttgaaattgctcataacacttggtattcatctcttgcattttgatgttttttatcatagttatttttataaaaaaactaatcaatgtttttgttccaacctatcgtcagttacattatggttggcataactcatagagccatgctatgggtgaataatggtatttttataatttagtattttagttggtaatctgtgacttcgcaatattataataatgatgattgctttgattctaatagttgggatgaaaggtttttactttattttattgaatattgatacagtttggatgcaaagggattttaacatatatttacacacagggttgttattaacttgaatagtttatgttcttcatcatcattttcagtttgtcattgtgcccccaataaaatctagtgttgttaagatgcttaattagctgaatagtttctcaatacacaaatcaagactctttgtgcaaaatcccttgaagatcagtacaccaacatccctactatgacttgtctgcctgtctagatacaagttttagtggaacagttaaaacaatgggtttgctatttcctgaatgaaattatatttatgttcttggtgtgcaatattccagatgtagtttgtgtcatgggtatttgttcaaatcttttgacgtaaaatttagtctataatggccttgttaccatattgatgtttataaagttttaggtcttgatctactggtacagtgttagaacagttacatatggatcatgttggtacgaaattcctgttcatatatgtacacattttattctagagatagattatgtggaaataatgtactaggtactttgacatgacggacaagtttttatttagtaagttgatatcctttttcttgatactattgttttaatatgaagaagttagacagagtaagctgtatcattgaattaaagtggtcatgtcacatttatattttagtatttaaattttccgaattcgtggatttaacatgtatattgcactttgcagcatagagtttgaccgagatgatgatttctttgctactgctggagtttcccggcgcatcaaagtttttgacttttctgctgtaagatggatgaccttttacttctattactacttttaatatcattttttatttcttctcttttgattgttaacatttttgtaatactgtgctttttatagattctgtcaatgaatgtttcatctattccttaggcactcatagttcacttagaataaaatatattactcatatgaattacgaactatgaatacgagagttgcactggtgctattactttcataccaactcaaccaatttatcttctttaattcaactacaaaaactggttcacaggaaaaactttattcttattatttgacagaacatattagtaatccgtcagggggtatatgaattatatgataaaataaaagcatgtaatattcgcagtagaagcatgtaatatgtgatttacttcaatctccttggaaatttggaattatttgatttacggcatttctggttaaatttgttttgtattataagtgcacctgcacaacttaaatgagaaatttgctgcactatatataatatgatgtttgaaggatggtgtatttaaagctagtcataaagcacatttgctggaggatttgctattaaaattagtgtaagggttcaccctttaaatgttgcttaaactaatagtaatacattatgaaatatgaatacaaaataaccattcccaatgttaatactttccaggttgtgaatgaacctacagatgctcactgtcctgttgtggagatgtctacacgttcaaaacttagttgcttgagttggaataaatatgctaagaatcaaatagctagtagtgattatgaaggaattgtgactgtttgggatgtaaccactcggaaggtaaatgttgaattcaaatggtcagtttgttcttgtatcagctctttgggtatattaattcattaatattgttttgaatgtcatgtgcttgcttaaattttctacagattatttactcctggctatcatttttcctttcgcagagtttaatggaatatgaagagcatgaaaagcgtgcatggagtgttgatttttcaggaacagatccctctatgcttgtatctggtagcgatgactgtaaggtactctgaaacatttatttggaagtttttctgccagtttccctaaaatgcttctttaatttctaatatttttgaaatgaaaatcatgcttaacatctgaattattatgtattagataaacttaaccttttgttgtataatcctattcatagttatagattttgccacctttggcattttggttagtaaaattcaaattttcttggcatggtatcttctgttgtatgattgaaagttattgatgtaaatgtaatgtctcttttctttgagcaggtcaaaatttggtgtacaaatcaggaagccagtgttctaaatatagacatgaaagcaaacatatgttgtgtcaaatataatcctggatctggcaattatattgcagtaagtacctttcattcagtcaaaacttagatttgatcctatccaggtattatcttgtatcgatcattcagcttagctgccaacttgtgacattgcttggcatttcgaagcaatatactttatatttaatttattataatatttcctcaggaaacagttcttttgtaatagtttgtgctgattgtacttaatagttaatatgaatggtgatattcacatgattgggtttcctgtctgcccatatattgtcttctgtaatatcgaccacccatcttccttatctgttttaatttttatatatctaatatgtacattctttgcatatttttgcaggttgggtcagcagaccatcacatccattattatgatttgagaaatattagccgtccagtccatgtttttagtgggcacaggaaggctgtttcatatgtgaaatttctgtctaattatgaacttgcttctgcatcaacagatagtacactgcgattatgggatgtgaaggaaaacttaccagtgagtaatatgaacaaaatgattgtttgctattgattgattcttatcacatttatccttcattttccatttaatttgtggacccatgttggcttttgttaatttaattataaccaataattttatactgaaaatctaaatattgacaattctctaatttctcatcgcaccaatattatgtttatttatggcatgtttgatgctcctgagtaccacttccttttgaattcaattaatttgcaaaacattcaaaatgcactacaaaattgattttgaagtgtgtaaagtggaccaaagctatccaaaacctttgtaaatatttaaatttgataatattttttgtactttctaaaataatatatatatatatatatatatggaatataaatataattttttctcattttcattctaatgtgtacaggttcgtactttcaaaggccatgcaaatgagaaaaactttgttggccttacagtaagcagtgaatacattgcgtgtggcagtgaaacaaatgaagtctttgtttaccacaaggtttgtggttttcaatgatgtgtcgttttcttgggcatttgccttttatggtactgaggattcaattgcccttttcaggaaatatcgagacctttgacttgccacagatttgggtcccctgatatggacgacgctgaagatgaggctggatcatacttcattagtgctgtatgctggaagagtgatcgccccactattctaactgcaaatagtcaaggcaccatcaaagtgctggtgcttgcagcttgaacactagaaaaaagaatagaatgtggaattggtattatcttttcccatgctattatgattgtatcatttattaattgtacatagtattcaggtgtatatggcaggctttagagatcttaatgaaatgttagttgagtgcttaaacctttatcaacaaaccaatttaagggactgaactataatttttgcccattgaagacctcaaatttattaaattttgaattaataaatgctcaggagacaataaaatatcaaatttggcatgtgataataataataagggtaaataattatttttgtctctgaatatgcaagagtgttggcaaattcatttctgaaagataaaaattcaaattttagtctccgaaattgaaaaaagtatgataaatttatttattaattaatttttatttattatcattaatgaaaaagtctacatggtacaaaggaatgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatattattttttcctctacatatttgtatcaaattgcttattttacatttctctctctttcttctttctatctctcacgattgtaattcttttttattattttactatataaatatgatttcttcccaaaaaaaatggtggagcatatagtcggaaaagttcaaacaagtttgatcactaattttgttacacagtgattacttgagcattttttgttagatacttgaacattagtttaacatatatttaaagttaataatcggtattattccaaaatcttaaaatttagctaatgctctttttactataagaaaaaaagctaatacttttaaaaatattcttgaccttttttctcgacacatttttatttatttctttttgcgctggaaagtggaaacacactttttccatttaatttcttttttcccctgaccttggtattaacaagaatcgtatttcttgaagttccaagatgaaggttggtaatccatcccttctaggttttagtgtacattacattccacatcagtgttggggaaaaactaacgggatctgtgtcaaagctactaaaagagacaaatatatgatgtcataagtcattccttatcttcactaactccatcttcaaaacgatgaatacattcattgtaaaaaaagcattacatatgcatagaagataaatgaactatgaagttttatagatgaggaataattttgaatatctaaatttttagaaactttaactactttattacatattatatttttataaataatttacaagaaatcttcacccaagtactaaatttttggacttgcaaggtcaagaaaacttgaacattattcataaaattaaaaaaaataaaacaaaaacataagaagaataagctcaggagagataccgccataacatctaccacactttcctttcattttgaattttgtggccttcaccttgaggggtcatgacaaagagcaccaaggtcatttcctgcaacaaacaggacatgatgaaaaccctaagaatggttgagatgagggagggtttcttcagattaaattcagctcagcttaaacagtggtatgagatgtgggagtgaggggaggtatatataatgaaaaactcaccagtgtcagcatggtccatataaattataataataaaaaatggggagggaaggaaaaaaaaaatcaaaatgcaataaaagacatgaaatacagaggcagtgaatataaatgatgattacctgcacgtaaaattagggttgatgtgtccctttctagcaagggtgagacaggaaggataatgagagtttgttttcttgggattcaaaaaatgaacccactattcctgcttgctcttaaatagtgatgtcaggttctgctgacattctcttgcattgctaccaaactgcaaaatatttttggtttcattttgaaccgtgaattgattctttgggtctttaattttgtactatcaggtccacttcgttgtaccatattccatttgcttcttagctagctacctacaacttaattttccatatttctatcttttttatcttcatgtatatatcctattcctactatgtatcatagggtttcaaaattatttatattgtataccaacatgcatgtttggttgcagtcgttagcaaactgcatgcactcggtttagttttgattaatgtagtaacttagttcattaccaagcaatttaagatttaaaattacaaaaacaatattttaattcttataattattaaatgttagttattttagtcatcatttttgttattttaggaataaagtgatcgttgttgaatattttcaaaattaaaatgatatttttagaattttaaaactaaattaatcggtttttctaattttatgtatggaccaattaatatatcattctcttagttttaggcttatggaaggcatactcatttattcatgaatcgtattgtttctaaattgcttcctaattgtggaaggtgtgagacggtaaattattaaatatgaagaagatatattaattaaatatataggttctagagacaaacgaatgaaggaaggaaatcggaattttaaatgatagagtaaattacatttttaaaagatgtttaaatagcatttcgtcctttccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaaattatagatttaatcctttgttaacaaaaattaacaattaatatttggaaataactttttttaaatacccacatgccaaatgccagagataccgtacaataaatacgcgtatagagatatagtgaactgttattcacaagaacaaatagaatgtagtaaccactaatcttactacctcattctactgacattcttatactcatttatctctcaaatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttagagagaggggatgaatcaaatggtgtctcagtgtaagtcagataaagtcttcaaactcataatatttaaaaaaatacttaatttaatttgttcatctcaagaaaacgagtgagaacttgaccacacaacctatcatctaaacatttttgtcgtttttttttagtatacaatgatagcattaacaatctaacataagttttcatgcatttacttatccctaccattaagtcaactctaatgattctatcgtctcaattttgtcaataattaatttctatcaaaaaatataattgattatctttagatggatttattccctcaacaaattaaggtccaaaattagtccaactgagccaaatctgttaatatttaaatcaactcgaagctcgacatgaacttttttttagttcaaactcgattcggttcaagtttgcgaataactcggttaaactcatttgctcgaattacatgaatcaaaagtaaaaaaaatttaaatcttatatatttcaaaagtttaattaattagtagattttagataaaatgattgtttaatttaaaaaaaataaattgtatatatatatatatagtcgtttcataaaacaactcaaatttaacttatttatttaaccaattgattattaaattgagttttaaattatttttgaactacttcagttcatttttaccactactttcaagcatgttttttctacttacactcaaacctgatatattgtgaagaataacaagtttttaagatattaattaagaaattaataaatacaaattcttatataatatgaatatgaataacttaacagtcaatataatatgcttctaaattaaaaattaatattcaatcaacaccagtgaataactgttagctgacagaagagaccataattattgaagttattgaaacatgagacatttggatgatattcttgacttttactcctcttgaaggtttttagccattccttattcgtcaaacatctgcatatcaatccaagaaacattcacttttatgggatgttctaccatgctgattttttacctgctgggagatcacaagcttttatttccgtccattaggtttttagtcattccttagtctttctttttattttcggcataagaactgagcttttttaattgaagaaacaaattctaggaccttctatcctgtggataatatagaatcaactcaatcaagactcacttatttcatgtttattaggggagcactaatttacatgactcacaaattcataaagagaaacgtgacaattttttttacgtgcagttaaaaataaatatattacagtattattttttctttcttttttacggtagcgttcacttattcttttttctttttagacaaaatatttatatattatttatttattattactaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttacaaaataattaacaggattttttttttataaaaaaaaggatcaacgtaaataccaaattttattataaatacataaataggtgatcaatatttataatcttaaaaaatcatttaatttatctaatgatatcaatgatttatatttctattcccacgtagtcaaggaccacctatgtcttctaattcaatgaattagagattaatcttctggttgttgttggatcaagaaaattttaaacactatgagatttgaaaatgagttttcctgtcaaataaattgttcctcttatgtgaacacaataagtccttataccattacgctaatcatatgagttactaatgatcgatatttgtaacgttttggtaaattattattataattaccattttggatatcttacatgaaatttgaatgatatatatttattcatttaaataaattcgatagatgaaatatcaaatacaataattttaaaattatataaaattttgaatacttatctacttactacaaaattttgtttcccaagaaattggtagttacaatagtttcaaaataaatcatatattttaaactaagattttaatcagtttttatatactttttatcagtgacgttaactaagattattagttatataaaattaaaatcatttaaaattaagatgacaaaaacattgaaattggatggggccacatgcatttgatgttcaatgccatcaagtggctatgtaattgggcattgctgcaaatgaaaagattggcacatacatagcagattgcagcagcactggagaatgcataacttgttgggtttttggttccctaccattctgattgacagagaaagaacataaacaaaaccctatgaacttagctacaaagggatcttccccaccagtcctactttactgaatgttgcttttgtccctatgcctgcaacttccaaattcacataaaagcaaaccccaaagccctaattctcacgtcttatgtaataactctacattgcagtctcataattgacccctgcactgcagtgtaaggtcaatctcagatggggtttctcattaaatgccccccttcacattgtaactaataaagtgctcacatttctgaacacaactaacaacaaagacatgaccaaaatggaactaaatgcaagtcatggtaaaagcaagttaaaacttttaactggccaagtgatatattttatgtacattattattatacatatattttttttataaaaaagaaaaacgtaaacaagtactattattaatttataaactatatattgtaattggttatgttatttgaatgaataataaaagcagtgtattgtgttgttggtgcttggggaccagcaaaatgtttaccatggctgtagtactgagacactgaccaattttggatttctggagtggtgtctgaaacattgtggggtattttaattcccaaactgagtgctctaactgaccaccttttactgcctgattccacaacctcgtgaagtcatcatgaaattttaacgccttgctaggtcaaccctgaattagttttccgtatcaacctactcattctgttaaatattcaatgacctatttccctccactgagctgtttaattagatcaacttctttttgaataaatttaatctgacgtttttgcaaaagaataatgcatgttccgtcgatagcatctttagaaaaagaaatatatagaagacagaaatacattttcttttataatatagaagagagaaatactgtcataggtgatacagtatactatctattggcacgagagaaattaaaatactattagagagaaatgagaggtgttaaaaccattggaatgtccatttatcattgttgtttgctaaacaacttcagtccagacataagattgattttttttttccaaattattttggaacgtaatactctcaaaagatgaatgaatcgagttatttttcaactcaccattctcaaaaaggagttgaacgaattttgatgaaaattaatctaattaatattttgccattcctgaaaaggatttctttcacacactgctaaggatgattgtgacagattgtgtgtttctcaaagataatacaataatgtacaagaaaattaattaagaatgatacatattaagattaaaaagaaaacaattaattagctgaactataagacgtaaatgtacatggagaatattcttggtgtagttgtagaaaaggggtgtcaattaagattataagagctggaagctgatgtgcaggatacaagagtaaaaaggggggaaaagccatttggtacataatatccaaagcttggtctttcaagtgaatgaatgttatttttttttttgtgtgaaggaatgtgtatgcggaactaccttgtattcaatgtattgtattaacttaataaaaaaatgtattgtatcataaagtggctttgcaaatatatatatatatatgtgtgtgtgtgtgtgttgtgtgtgtgtgtgttttgaacttgaaatggtgttttttcacgacctttgcgaacatagcacacagctaattaggatgggtgcagatcctcatgctcatgcataagctattgtgattagatacttttcggtgattaaatgacttagtcaaatgtgttgggtaacacagatcctcaaatcaaatgcagaagtcgaatgaaaaggaagaaaacaagagagaacacaatcaatctatttaacgtgagaaaacctttctcaatgtgagaaaaaaaaaactcacgggaccttgtccagaatcaaaattcactataacaataatcggttacaatgaatcaaaacacaccaaggtggtggtacactcaacctctccaacaatggtgatcactcaaacgctcacagtgtttcactctaagctctcaaatatgcaggcacggaggcttgctcaaatgtgctctcaagaatgtcacttgaggctctcaaatattctctgacgactgtctacgtctgagtctctcaattctgagtctacctttcttcacccttaactaatgtatttaaaggagtgaattaggtttagtattttagaacccttaatgggcctaggtcaatattgaaggagtaaaggcccaatccaacaattctcccctacaacttcaatgcgtcaaaatcaaaaccaggagctcggtatcttcaatcaaacagcccggcatcttccatgcgctggcttcttcaaacttgacgggttcacaacccggcatttgtgttgcctttagcaacaacaacctggcaatgtcattgcgatgggctcaacaacccggcaccttcacaacaatcttcaaatttccttgctggtaccggcttggtcatcatgtcaaaccaattcaggtcgatgtgcactttgccaagtgcgagttgtctagcctccaccacatcctggatccagtgatacgtcacatcaatatgcttggtacgggagtgatagatcgagttcttcgcaagattttatagtgttaggtaagattaaagatctttaaagattttttaagatctttttaattattttgtttagtggtatattttattttgagatcttaaaaaaaagaatttttttttgaatattgtgcagatcttaagagttattctacaataactcattctccacattcttcatattaaaaatttgttcatttcctttattagaatatgtaatcaaaaccagatattgaacttaagatctttactaagatgttcaacagttaactaactcattgtgtgtttgagtagaagattataaatttatgtttcagacaaatatacgtttgcagaaatatcattatttttatttttatttttaataatagtgtccaacatatttacaacttatattaaaacacatacttaattggttattgttgggccctctccgtgcaggcagtgacggatctaggaccttggattagtgaggacaatttattttaaaaataaaaattgataattatcattataatattgattagttggattcaaacacgaagataagagttacaaaatataaagttttaagataaatatttacattttattaaaataagagggtgtatttacttactcttacatgtgaacgggtaaagaggttcaaatacataaaattatggggttcaaaatataaaattatggggtataaaataatatttttttgcattttattaaaataagatggtgtatttatttactcttacatgtgaaatggtaaggaggttcaaatacataaaattagaggatgcaaaatataaaattatgggatataaaatataatattttaggataaatattagtgattttattaaaatggtgaccctggattgcatatagatccgcgtgcaggcttgctggaagtgagttcaacgtaccaatgaacctgccaaagatgcctatccaccccatgaggccatgatgctgaaaggattaatctcttcaaagaaaaataacggttgaaaaaaggcaagtctcctcacatgcatggaacgttggcatcgaattagtaaagagaaatacaatatttttatattattttctttatgtataaccaatagaaataggaagaggagaaaaggatgtgataaaataaaatgatatgatcgaaacatataaagatttttttaaaaaaatgttctaaaatgtcatgtacatatatagatactaggcaaatggttgatatatatacccaatttttaagacgttggaggtggacaaattaaagatacggaataaaataaataaaagagaaggaaaagacttattgaataaatatctagtttggtttttgaaaatgtagggttggtagtgccaagtgtgtctgaatgttgctatattctaaaatactctctcaaagtttagaacgctaatccatttagtctctccatcacccattaacactcatctaagcatccatgtaaccaattacctttattaattaagggcgataattcaatccatttatctatcattcatccacaagttaatccactcaatccatctattacaaacaaacaaagttaaatgaattgggattaatcaaagcttccgatgagaatatttgatatcaatatcatagttaaaaaaaattaaatgaattggatataatccatcaatttattttatgaatgattaataatacatccattattttttaacatccaacgaattctccaaataaatacttaattccctccatttttctgattagaaatccacattgaactatatatcatatcttgatccagccgatttgaagactaacttgaaggttcgtgagaagcctgtgaagactccaaatattattcttataattgatagctttttgcgaaaaaaaattactctgacaattatttgggagactatacttgtcaactttttggtagcacatgttgtacgaagaataagaatatgaaaatggtatgaaaggaacttggacccaatgaaatgaacacatacattgaggctccatgagcgtgagattctcgaaacgaaacggaagtcctaaaatcactgttacctacaaggatacgttatcttcggagaaaaaaacaatgcatgtgagtctcttctcattgaattaagtcaaagtatacggcgttttataccatatataactgcgtccatttttttttttatcatattgaaaaagataatgttaagaaatttataataattgcgtccatttctctttaaaaaaaataataaatacgttcatttgttcttacagtcaaaagcttataagaatagtgaagctgtgatgaaggcacccgttttcaggtttctcatttattgagacgtttggataagctaactaggcaatgcaaaatgcttcttcatagtattaattattcttgttattattattattattcctttgtgtgcattttacgtggtcaaattcatcgttgcatttttacacgcaaactaacccttggttccgtaattgatgcagctcataacatcaactgagaatctttttattttttaaactggtcgttagcaaaatgataaaccttttcatgcataaataatcaatatactttgattagcttcgaattaattaattttctcttcaactaatcctttattttagtatattgtttggcattaaacataaaaaaaaagtatattgtttgacatagtttagtacggatgtgcaagcttgggatgaggggaaacgtaaacaaaacaaacgtacatgaacattaatctttgctatctttagtgagcatccacaagttttttttaacatttttattttaaaaaatataatttaaattaaaatatatttaaaatgaagtaatttatatttagacgctttatataaaaacaaacgttactataataataataataataataataataataataataataataataataataataataataataagacactagcagtataaaagtgtttgttattgttattcaattataaattattatatatataataaaattattaatttttataataattattttaaaatcatttttaagatagatcattgtatttgtttaattagcaacgtaaaaaattcacactaacaaagaaaattaaattctaataaaaaacactaaagtgaatttggatggtccttgacatgttatagcttataagtcgtctaccatgtatgggccttgcccatgcacatcttgtatgggccggcagccaaactaatattttaaaacctgtccacttaatttacctttttttttataacaaagtttgttaaaactaataacaatttatttattttttagaagaaagactatacactgattgtgttaaataattttatactattattcaatcacaaattaaaatatatgataaattttttaacttttatgataatcattttaaatgtcatattaacaataatttatgattatatggtaatgtaaaattattttacattataatgcataatcattaaactttttatttattcataaatatttttggaaacttaaaacattagtaacaaaatattatgtcatcgaaaaaataataaatttcaactattaagaatagttaagaaaagttacgtcaactaaaatttgtaagaacaaacttcagtgtaatttaatattgaaaaatgagtcccgtgaaaaaatttaatagtactcgtgcagtttcaattttaaatatatatatatataatatatagcaattaaaagtgatgtatcttaattaataaatattgttttccaacttcctccaccgagaccaagagctataaaattggtgaaagatttttctttaaaacatttatttcaacttgatatttttcacttctaataccaaacaggcacgacttttgcctgggatgggaagatggaacgtgcagtgttgaatgacttaacaactctacgttattgtaagtcgtaaacccttaaaaatttaattaaccactgtatttgtgacttggggctttgacatggaagacattccaacccataaaagagcatatattattcaagaaaacctatccaatatctcaaaacacaaataattttcgatgccttgggtgatacgttaaatgtcgaagaaatcaaaggcatactcttctgtattgacgtcaaactagctggcctgcctctgataattttgcaaagcattactcacattaatttgagagaattaagaaaaaataagtttgcatctctcgttctgaatttctcataacatgcagcacacgtaacaataattgaatagtgcaacctttttctctattattgagccatttggataaggagaagcacttttgcgctttactcggcccatcgacaatttctagcatgttcacacttcatagtacccttggtttccacacatgatgcaactcataatttcaacaaaaatttgtttcattcactttgtactctatgatttaatattggaaagtactataaagaaatcaataatgcgacatttaataattaagaatacgtttttatcatgatttatcaaaaagaaaaaaaaattatatgtattaattccatgtctataattgttacacatatatttcctctcatctcaaatatattaaaaaatcttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatcggataatgtcatggttaagcatgcttgagattaattaatgtgatttaaaattttaaaaaggcagacattttttttgtgtcacttccttttctcctctttgaagaactcaaacaaatattaatttgttgggccaatcttctgtagtacgcgtagtctacttttaacaagatagcgactgatcaatttaagaaaatagtatagttgcctcatgttttgaagcaaaatattatccacaaaacactagctagataatttcattgtttggtagcaaatgtcatggtttttgagtgttaggtctgctagcttgtgtttgcaatgaacattgctgtctagcgtttaccacgtgtacaagtgattaattatacaagttttacactaataatgtatgacacgattagttaatagtattgtagtttgttctcttgggatactgacaagagatttatttcctagctgctttatgtatggaaaactttgttggaagaaataatattcatttcatgattttacgtccgcaagaaattgatcttcgactgtggttatgcaatttctttagtgaaaaaaaatacacaacttttacagttgaattcaaatcgcaaaagtattattagactattaacactaatttttcctctgtagtttgtttacatatacaggtgcacaaatgagagtatagcaattggatgcaacaagtatcataaattgctaaaaatgcttttaaagtcaaaatcattttattaaaaaagcataaataacctacttcaaataattgttattttttttatataattgtccattttaagaagaataaaaaaaaagtgttaaaatacaatattatcaaaggcccctgaattcactgattatcaaatgggaagtatggaaccttatcctttttgttaccctagtcgttctgacatcaacaatgcctattatagagggtgttagtataatttgagccaaataacagcagcttactttgaatgtgcatattattaatttatttggataatacttgaaaatagccatcaagagtttaaagtaatgtcctcctaattaataagcaatgattatgactttcacgttgacataagccgttggaggggaccatattatatctacaagtcatattccataaagttcattctaaaccgttgcttgagctaattggtttatagcttgataataatatatatgcaataggattccctacaaaatttaatttattgtataatagctccagatactgaatgagatggaaaccgtccttcgtttatgagccaggcattttgcgcaccataataggtgggaccaacataacccaacaattcaaatcacattaaaccaaaagaaaataacttatcaaacatgaaaaacaaaaccatgcagatcttacaacccttaggaacaaaggcataaaattagaccagttaattttattttgttggcaacaaattattttttttctttccttctcctactttcccagacaagagatacaaaaaaaaaagttgaaactcagtcgcaaatattattctttcatggtcatcgaaaagttagacctgattatatatattactatatacgtaatcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttgaaatttatttaaaagtatattggtacgtaaaggtcatgtgttaaattatgactaactaaattcattaaatactctcctagtattctttttatcatttattataaaattcgaaaacaacatcttactttgaaaaaacaaaactccgcttgataaacaattggttggatttacacttttaagattttatagacaagcatgaatacttgtataattttacgaaaattgacccatcatcgatttgatcaaaacagtaaattaatagttaaatgggtgtgtcactaattagtccaatttaattttgtatatattaaaaaaatatatatatacaggtatagttaatataatttgaatgaaaattttataatccaaatttaaaacattagaaaaataacagttgaatcatccaaaaataacattatactatagaaattatttttctcttttatatgttgactatccaaaataataatatactatgaaaaaaaattctttgtgttgtatcattgtttgctagtcttaagaaaaaaaaatcccggatgtattaaacttgttagtaattatgagcagagcagatggatgagcttgacttagtggtaacactagcttggttttgtgtgtttgaatctgttgataacattttgtaattttataagatttgcttctagatgttgtttgcacgcatagaaaatcattctcaagattcaatatctgcatataatatttggacacgtcaaaacaatctttatccctttgtaaatactgactgtacgtaggtggagtagtggtacggggttgaaaattgtcacacgggttcttttcacttaacttccaaataggttaaggttgctccattggaagacttactatccatcaatttaatgttcaatgttgcacgattgaccaaattcaaaatacttcattttcacctttaagtatatgcttttctaataaaatcttgagtcattttaccaatcaatttacaatttttttttctctggagttacaattatgttatatagagtaggaccactgtaataacactattttaagtgagaatataagaaaaattaataataataattatatcaaaattaaaatatttaaaatttaaaattaaaatataatatattattaaatttttaaattattaataaaataaaatctataaaaatttcaattatcacttctaagtattaacatatatcaaataactcatcatcaccatcaagattgtcgattctatcactacaatcgtcatcgctaacaccatcattgtcgatgctatcatcacaatgatgatggtgatgttgatgaataaacgataattgagatattttaatatgatttgtttagtgaatcttttaaagatttaatagttatattagattttaattttaatttttaaatattttcatctcaatcgtctattatttttaatcattatctaatggttgttattagttgttctcatgttctcacataaggaagtatttttacaagagttgtattcatgttatatatatatatatatatatatatatatatatatattcaaccgttagattaaaatgaatatttcaaattaaaatattttaattcaaatttcttataaaaaattaatggttaaattaatttatgacgtcttaaaatatctcaaatctatcatcaccatgaccactattactttcatgactattttcgccataattgtcatggtcgtcaccacaaccaccaacatgattatttttgtcgttactatcgttaccaacatcacgatcgcctccatgactactgtcatcgataccaacatgatagtcgttgttgtcgtcaccactttagtggcaaagataacaacaatcatgttggtggcgatgattgtggttatgagaacaatcttgatataaattaaatttttaacatatttgataattttatttgataaatcttatagagattttgtgattaaatgagtttttaatttgaatttaaaatattttaatctcaaccttttattttaatctaatggttgagataaattattcacattctcacataagattgtcattctcatatgatacattatctatatatattataaatttaaaaagtaaataaatcaaatataagtattagtaacaattaataataataataaataaatatgttcatgtaactagatcgtaactagagtttaacatacctaaccagaagcatttaagtgagacaaatgtaatcatcctctcaggtctgtcactgggattcttattcacgttgcccccatccttgagtagtaatggtaaatcacgctttagttctcccttaattgctatgattggcatatgtaactttcgggcgactcagggtcatgtttgctgtaaggcaatttaggcaagtacattagactcccgtagaaattaaatgcttattacttaatcacaaggtccctttttttttttttaagtaccttaggtccatcaatgtcattggcttaactttttaagttgctagtataataccattttaaaatctcaatgatacatatatacgttaggcgtttaagagattataaaaatgtgtagctgcaactagtaagtaaaatgtgcaattaagaaaagaagataaataatcaaattctgtctgattttgaagatatcaatttgtttaaattttatctgagataaacaatattataagatagattaaatggactaatcatcgtgtttattaagaatgaaatattagaattataattaattatataaaatattaataaatgattttgtaatcgaaaatattagatgacgtatctataaaagttttgtttaaggccctaaaatttctaaacacggccttggggtgactgttagggttcttgagattgcagctagaagccaatatttggggactgagtcggtcaacatacgaccggagatatacaaaatcttagaactattaaattacaaaaaatgatgtaacttgatccctctttgctctctctctcacaaacattttttatttgagtaaaaagaaattcacaattgttaatttattagaagtcttaaaatgaaaaaaattatttataaaagaatcatctcttcaaaaataaacttttcaattcttaaagtgaatttccaccattaacattaccttgttattctgaagaagaaaaaagaagtaaaggcaattaacagtcaaaatacttttacatgtgattatcaggtagaaaaagacttttgagataaaagtacatctgtaaaaagatcagaacgaaatttcactttttattcgtctgcaatggaaaatgtatcacaataatttttattgcaaactaaacatgtacgtaattatcacaccactgcatcctcccactaaaacgatttccacactcaccagccgagggtcaatactcaatcggcttcgtacgcaagggcatctccatctcactccattaaactgaacaagaaataaataaagtttgtaaaactaagcacaattaattaaaaattgaaaagacccgacttgttaaagccaaattaatattcttcaattaatgggttcctttccctctatgtttgttggtgacttattcattcttcccgtgtggttcttactgtgtaaatcgaatcaacatagccgaaatgtgacaaaagatatcaaggacaaaagaatatgaccagttactgtgtcagctggatgaaaaaaaaaaaaaaaaaacaagatagaaactttatactacttttcttcttttttaagcaattttggaaaagacaaaaggaaaagaaaacaataattattcgtcaaacactcaaacctgcaattctttcttattattttaaggggggaaactttatttatcgtttttgtgaacattccatgtgtttaaagagccgggtaagcagtgatgcaccatgttagtgatattggtcttaacaaaaggcctaaaaaaaacaaataaagcctatcatgtatgtactaatagaatgatttcttttaaataaaaaaataaaaaaagggaccgataatagattgaattgatatcttctatttagaccattgctaatagtgccgtctttctataggttttaacttttttttaggttatattatgttacattaaatttaagaattttaccaatatttttcctctaataataaaattatttaagaaattaaaattagtttcacatcaataagagaacatgtgtgaaaagaatgtgttataatgtgttcttagcatttctttattaccccacatccatatactttgtatattttttttataaaaaaagttaatattaagaataagttcttacaaaagaactattcttacacaatgacttctaacacaattttctttaatcatgaacttttataagaatctattttatcattaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagtatagaagatcatttataaaagtaatttatgatatattcataaattattttcaacttattttaataaaattttaattaagttatttacccatacaaatccttaattaattagttgattactctacatataatttatatgtaagaacaataatatttattattttcatttgcctaaattatattttacaacacttaccttgtaattttgacttgaatcaagttaataagtgaatttgagttgaaatgagttcaagttgaaaataatgtaaatctttttacaaacttacataagttatttaaagttttaaacaataaattgaatttttatatgattgattgttagaagaagaagaaaaacgcaaaattcgagtctaggctaaggaaagaagagaatatttttggtacactttttgttgcactttctggcgtgagatggggaaatcagaaagaaaacaaataaaatataaaacaaaacaaataaagtaaaactagcaaagcaggttggtatgtggcgcagagccctcgctcgtactactgagtaatgaccatcattattattattgttattcaatttatttatttccttttccaatggccaaagtacaaaagggattctcagtaccagcatattccttcgaatgttctattttcctctttaatctttccagaacaatagaacattaatcattaacctttttttaaacacattaatcattaacctattcaaaagtattaaaaaatggtatatctatagtattttagtattgttaaaaacaatatttttaccaataaattattagtctaaataatattaaactcaattttcttaaaatttcaaatatgagttttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttaataacatttaaaattttgattcccaaaaatcttatatagatatttccaacaacatttatgaaaaatcaaacaaattttaatcatttataggaatcataattcttaggctaaataaaaataaataaatccttgtaccaaacgtcttattcatagagtattcccaaccatgttgcttgctgtatttcaaatccaatttctattccaatttatcaattgccatcataaatctgaggtcagttataaatgaccaatttatagaggcattaaaaatagaggcaacaatctatttgaaagagatgaactagaattagatataatagtttagatcacatgaagttaggaatgggattcgtgatccctatatacaaaaaattaggtatatgtaatgaaaaagggaaacatgacaaagagaagaatgtagcttagaaaacttactggaaaaatgacgaactttgcactttaatgtctcaaatcaatggatacatcacttgatcaatgaatggatgggtgcatcactaaaagggtttgcaagagagacatcgttatgcttttctagtattatgaccctgactgagtttcgcattgataacataaaaaaaaaaagtaaattatactcgcactttatgtgttttacttaaatttcatctattatccctccttttttgcatattacttttatctctttctattaatactgttaactaacgttaattgaaatatgtgagcagataaaattgtatttacattttaatggtaaaactcaaattattttctcccaattagtttcagaatttaggattcacatttcatttctcttcaccatttactgtttgtcttcgtcttgttagcgagttcttcttgagcgtctagggggtacgagttcctctttctctcacgacattagttcaattcctattcactgttcgcgagttattcaccgttcatgttcaagttcacgattcttcattgttcctcttcccgttcacgagttttctactgttcattttccagttctcgcaacgttcacgagcacctccgtttgtcttcttcttcgacgttcacgagcgctctgtttctcttcttcctgttctacgatttctgttcacgccaaggttatgattataagtaaccactagaccttgtatatagattactttttaagattatttatttaattgtgatggttaattgttatctatttctgaatgagtttcaatgaggaccagtttgggaccacttatgatttttaaaatcatttgtttattattgttgattaaaatagtgttgatggttaggaccacataaaacacaatggatgaactggaaatcatttgtttattattgttgattaaaatagtgttgatggttgagaccacaagatcataatggatgaagtggaatacatggaatacatgactgtgtaaacaagccccttaagactgatcatgatgtgttgaaaatgggaaatggtgttaacattatgtaccaaaaaagtaggttcacatctaacaaaaagttgagtttacgtctaattacataaaaaaaaaaataagagtcttaaaatattttcaggttaagaggaagaagatgaaggtattttagatataaaatctcattaaaagtcatgtgaccaacatgtgcctaatttatgttagattattaaacgatgttaggaatgagagagtctaaatgtaatgtgaactaaacaattatgagattttttatagggtaaaaaaagaagaaatatcgaataaaatttgaagaaaacaagtgaggtacgaatgtaatttactctaaaagaaatacttcttacaaaatttcactcataactttcataatttttttttatcaaccaaaggaaaactaatatatcgagggcatcagacatgccaccgaaaaggaaaattacaaaaacaaagaaatgaagaaaagagaaccaaggtaaaaaaactacttaggcaaatgaaaaataaattcttgacaacaactaattgaagagattgtgatttaacgttttgggggccggaaacaattattgcattcttgacattgtcgtgtgacatactctattatgattagttgtacactagtacggatatattcgaatatgtaaaatgtaaattatatacataaaaaataagttttatcaatttatattttttttataaataatttatcaaaaatcatattttaaaaataacattgtatcttttttttaaatatttataatattaattatttaccttttagtgacattataattgaaaaataaaagtttaccaaatattatatcttattgaagtattttatcaaacatttcaatataaattataattttaacgtaatttgcatattttttatttgtacaatagtaagtatatatcagcattttttgtgatgtaaacatagacaaaataatatataattaattgcacatgataaaatagaattaagaaagtgctaacaatacgttttaatatattaatattatctaagaagaatgttaaccacatagtttataacacaatccttctagtatattaaatactatgttttattgaaatttataaaatcttaagtcaaacttattaaatattaagtgagatgtagatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcatgggataactaaatataaataagttgccataaaaaaaagttaccaacgagaagcatcacactctaggacagggtgaaaaagttaatagataacatgtgattatattgttctcattcaccaattaaatatcgggaaattctatttccacgtattgtttgtctgacatcagtgacacggtccacaaaaatcaacctaaacattcaacaagatagactaaaactaggggagagaaataaaattaatagaagaaaaaagtgaatggtaatgcatcagacattgcgagatacttctagataactactattctcttaaatatttggtttaagtttttaaatgcataaagtctaaggtagtgttcgattggtataaaagaaaattaatgaaagtacgagaaaagaatgaatgaaaaggaatgaaagagaggtgaaagaaaatgaaaactatgtgtgatggttagagataaaatagaaatgaaaaaagagaaaaaaatttaaataaaaatgatttgaaagataaaagaagaagaaaaattaattttaaatatatgacatcataattaattttatttctttgatttttctcaatataaaaaaaatatcacatcgtgattctaactaatctcttcttcaacatacaattttcttaaaaaaatgtgttattttcactactttcatgtcattgtagagatgaaagtgtttttatgaatcacactacattttttaaaagttttcgtttttctttcaatacaaacaaacaacaatgaattttaactttccactattttcataccatttcactttcattcctctctttttatgtagaaacgaacaaagtcttagcatgcatcgaaagaaggttgaagaaatagcgaggaaaattttaaatttattgtggatcccttgcaaaaatatttttccacttatatgcgaagatttgcgaagaaatgacctggttttgtgtgttggatcttgttataacgttggctgcatacaaaatagaagagagaggagctcttgtttctcttgccaccacaaaagtgatcctaatttgcatgtttcgggcaccggccaccggccacctcgctagcgggttagtagcacagcccctgtgaagcactgcaaccgcgacagatctcgtcactgcatggtctcgcattcgccaccaccatgaacatcttgtctttatagatctgtgcctgtacaagtgagtttctcagaggaagaaatgcctcacataatcataaattattttattaataatatattttttaaaactatataataataatgtcaataacaacatttttttaaatatcaaacaattttaattcaagtatttcatctctatttccacttcatttatcttctaccaaacaacttatatttttctttatttttcacctatttctcttcttttaacctatctactttcctttcctctatttcttttcccctatcaaactcaaacttaaagagatataatgttttttttttatcataaagaaatcaatggctgtttgagtatacaataataataaaaacaatgaaaaaaaagagataatttatatataataattttgttaactttattttaattaatgattaagggattatgatttttttatatcgatttggtttagtttatttgtagttttacttttatgcaacactttttatatctatgtatcgaaagtaattaagaacttgatatttaggatttaattattagttgtatgcatgaaaaataaaactatatatatatatatattaaatatatcattattaggcacaaccaataataaaataacatgtcagtcaaaatcttaaacaaaaggaaaaaaatgactatttattcggtatgtgtattaatttaagtgggtatcaatacattaaaaaatatattttaaactcatgtataaataacattacttaattattaacttgaaaataccatttatggttagaccgtattttatttctaatttttgattgatcatttatcattaaaaaaaattacataattaacaactttatagttatactcatcctcatcatttatcattactttcataaaatttaaagtttgaaaaaaaatcttaaaacaattttgttagtgcaaggacaacgaacttagagatctaacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataattaacaactttatcgctatactcatcctcatcatttatcattactttcataaaatttaaagtttgaaaaaaaatcttaaaacaattttgttagtgcaaggacaacgaacttagagatctaacaaaaattcttcccccgattccttaataatcaacaaatttatagtannnnnnnnnnnnnnnnnnnnnnnnnnnnnnnnnnnnnnnnnnnnnnnnnnnnnnnnnnnnnnnnnnnnnnnnnnnnnnnnattatatttataaggcctcataatttatataatttatcctttttagaactatttttctcatgagacaattttatttaaaatacgatcaaatattaaaaatgaacacatctctcaacaaaaactttaatttactatattgtaatacttaaaaagttattttttttttcatcaaacaaaatccttatattacagttgtattaaatattcaaattgaatactttattatcctccatattattcttatccaaccaagtaagatatttttaaagaaatatctgtagtctatatagactctataatatatatatatatatatatatataaatgtttgttttaatttgtttgcagagaaaagaaaagaaacaaagagtggtgtcattgacattttggtgttgttgggcacctctgtgtctctctccgatgggtatatcagcttcttcccattcacttcatttcattcacccctttaactgtcatccattctttctctctcgaaaggacgcaccagtcaaaaaacaaaagccgttccagcttgaggggcaggggtaccaccaccaaaggccaaaatacaaatcaaccatctcaacgaatatcctcttcgatccctttctctatttccttttctttattatataatcatctacaaactcacacacaccccctctaaatacttcctttacccccctctcaccttaaaacaaacaaatatactactaatagtactacttcaaactttgatatgcaagtggcggcagaactccaaagcacccatcaccaccaccaccaaagacaaaggcaacaacaagacaccacccccatgtgccgccaaattcagctcactatctccgatcacaccgtcgccggagacgccggcgctgacgacggcgaggatctcttcattccgcccctcaacttcgccatggttgataatggcattttccgctccggcttccccgaacccgccaacttctccttcctccaaaccctgggcctccgttccatcatgtctgtccaatcatttcaatcaccctcttctaccttttttcttatgttgttgctgttgttaatggtgttcttgttaacattcgtgtttgtgtgtgtggttgtgtttgagtttgatgatgctttttgagtacccaattgattaattgtgagtaaagtcttcatcttttcctcgcacgctgttgctgattatttgattgggtgttttttttttttttttttacagatatctgtgtcctgagccgtatccggaggccaacgtggagttcctcaagtcaaatgggatcaagctttttcagtttgggattgagggtcataaggtctatttctatctatctatctatgtcttcaaccttcttttttctggtcttgtgatttctcaccttccatttgggtctgattgttttatcttgaggtctatttgaataatcttgtctataaggaattataatcataaaagaagatgataaagagataaaatgaattcagcttttcgtgcaagactaagttaaaatcagcttagacacttcagccttttcctgtaagtcaagtttttggagaagtttttaaacttttcttattttcttattgaatactaagtgactatacaagaaatttatctaaagtctgaatttgattgtggttgttctatgtcttggtaatttgcacaaagttcacaacaaaaagaaaaatgaatagctggcacagagatcaatgaatatctaatccaattgacctgtctttctcattctcttctatattcttaatataacttttctatctctcaagagatgggtgtggataattagtgacctgatgaactgggaccattatatggatgctttggtttcaagtactgtttaatcaaatgggttgttatgagagggcttgggagataaaaaaaggggacgtaaagcgggttgttgtcattattatttattcaacttgtttacttactattcttcttcttccttctccttctattcttgcttgattcttatggcgtaacttttttgaaatgtccctaactttataagactgatacgaaagcaaaactacttcggcaccctgcgagtcttaaaaaatgaataggagaatgatatggtccgttagatatgaacattctacaattaatggccaaaataggtaaggatcaccatggaaatacaagcactggatttttttaataaaaaaactctttgaagccccaacccaccgtccctttccttgccgaccgcttgacctttcctcaccatggacgaccacaacgccatcgcatatcccgctgccgccatggacgaccccgacgtcgttgtgcaaccgagaatccacattagatcaaattattttttttatttttttctttccgtccatttagaccaccgtgggcattctccaacattctcccccggatgatctgccacgctttgccgatattgaacaaacaagaaggttccattcattgttcgtatctttcaaaacaaaaattcaagataaataatacccattacagacgaatctgcaatgaccaaatgttttacggtgtgaaatttgaattctaaaaatttatccagatttacaaaattttgcaacagaagagttggagtttggttggaaggcaggtggaatgcgaggcagcgacagaggagcgcgtgagggaggagaaggtgaaaacaaggtcatagattccagatctgttgtttgagaggccatggatctgaggagcgagtccattttcagatctgaagcatgaagtgtgtttctagatttgacgcatgagtacgattgcagatccaacgcatagcgatgacggagagggaggtggaggtcttcgacacgccggactgacgaggatcctgatgttgttctttttgttgttggagtgtgtgggtgttaagtcatttgtcgaaagggggaagattttccagtgaaaaatatcaagccgcaagggagacacggcgttgcagatgacaagtgatagagcagcaacgtttccttgaagaagatgaaggcctcacggtgtgaggctgaacttgaccatgaatggtgtctacgacgccggtgaaacaacggagaaaacgaaagaagagtagacgtattctgtttttttttttttcttttttcagtgtaagcatgtcctctgtaatgtcagcaacagttgattgcatttaatgcaccgtattaccccacggtgggaaaggagtttctccatagcatctccaatggatggtgggtttagaaaccgtttcttagaccaatggataatatgagagttcattttaaaaaaaataaatttttaatgtaagaaattctttctagtttttacaatttcttattttttcgaatatcactaatcgtggagattttgtggagtttcttatattagaacaaaattttgtaagaatttttcatgaatgagataatatcacgtcagttttggtctccatattgttccggattatacgttgttttatttcttgagcatatttctatgcgagagtcctcttcaatcctcactcgtatgtgcacagtgaaattatgtcataccaactttaggatatggaaatcagggttgatggaatccaggctggcatgccaagtctttttccttggttatccaaaatgatcacaatcatttgtttttcgggaataatgaacagttgggagatcatatattatacgtgttgtctgtctaatgggaccattatggatatctgaaaaaccaattctgttcaagaagagcacagatttgctatttgattatagtgcaagtacaaaaagaagggggaagggaattaataattgttcagaagtagcaccaaagtcatgatcaccctaggaaagactaggtaatcaagaagggcatagtaaagtatagagaacatttcattattacatttggagattgaatttatgttattggtggatttgggcatattgtatgttgaatttgaatgacttctctaaagtgatgttctctaaagaatagtgcactcacaacccttgattagaaaaatgaaagattgccattataattaattttaagatttgttatatatgtatttgaatttatcaaaattctcaactgttgattagaaaatcaacagttgttggtgtgcgctttgttctctaaagtgtatatccactcactttcactttagaaaaaccatagaaccgaattcattgaattaatatagagaatacttttcctttatattgttgaattcctgactctctattccatgaattttgtttgaatattaaattatggaccaatctatatgtgaagtaaaacaaggggaagcagtacttttattaaagccatccttgattatgatactaacttgtgtctctttccttaattttgaaattgttttcatgccttttttgcccatcttctaattttcatgtttattcacatctgactccatctgtggaaaggaagatggtcagatgaatgagaattgagtgatggtttatttctacatgcgtgtattgtgtaagatttaggtctgtataccagtaaaaaaaataaaaattgggatctgtatagatacattaataatctaataatagcttcttttggatcccataaatcgttcagtcaatcaatattagtagttgataaatttgccaaacattatcctcaaattgtattagccacacggcccacaccctctcccctcttccttttttaccaacaagtttagttgacaaagggtgatgatggaacttgattttaattttatgttaagaaagcaagttttagataaccttgaaatcttctttaaccttgtgcatccaggagccttttgtgaacatcccagaggacacaatccgtgaagcactagaagttgttcttggtatgatgtagttctttacttttaatcccaactgcagtttcaacaactcatttaattttgctagcaataacttttggcgatcaaataatgcagatgtcaggaaccacccagttataattcactgtaagcggggaaaggtgagatttttgctgattttttttttataaatatttttgtaataagtaatagtgtcactaacaatataaaacgtttttgtaatatctacccatgtgagatttcttgttaaaagtatgtaatcgcttcctttttttctgcatgcagcaccgaacaggttgcttggtaggatgctatagaaaattgcaaaaatggtgcttgtcatccgtctttgatgaataccaacgctttgcagccgccaaagccagagtttcagatcagaggtttgtagagttgtttgatatttccagcctgaaacatttgcccatacccttttcatgtttgaagaggtaacataaccaagctatgctgagttgggtttactttctttagtttgtgaaagtgaagccaaggttcttcctttgaataaataggaaaaggtgatgaactccttcaatgcattgcagcggcaaaggaataattcttctcccattttcaaaataagacaagaaaattctaggaataatagagcattacctgtatttgtatgtgttaaaattctgccgtatatttcccttctctccctacaattggcccttagtgtacctcaccaccttttgttctattttctttctctttgtttttatgtttttcttgctgctccccattcatcaacaatgagtgtagatatatcttgattttttctcgaggctcagaaaaattcaagaaggctacaaaaatgccttgtttgtctacccaaaatcttggtgggtagtaaagcagaggaccttataaaatttcatttgctagattaatattgcttttcttattttatgttgacactagcccagttcagtgcgatggttattctcttacgctaattgcatgctggtggaaaacgtggcagtgttttgtagggacttacatatacttgcattttattataaaatataaatataagtggaaaatttatgcactttgtaagcagattttttttaattccttttataatatctttttactcatcttatttatttattttatgtttgtttttacgaagtatttggaggattaagtttaccaatacatttttggtaagaagatatatataaaattaaagcagaagggaacttaacatacaagaattttgttagtatgaaaaatgtattttttatttatgtagatattcacaaacttttcattggatcttatttgtataatgtctgtgataatgacaggaagatacacatattttgcatgagaatgttatgaaaaaaatttaaggtgagaaattttattgtgaacgtattaaaatggagtgtcaaaatagcaataattgaaagggactaaataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctagattttgtaaaaaaaaaaaaaaaaagcaaaaataacctaaaagaaaaatttagagtaacaataatgagtattaccgtttttgcttaagtatgtaataatctcaaatgatttcttctcgccgatctaatttcgcaggcgtaaactacctttttgctttgctgttttcttttcccttttctagatttctttatggccactggtctaactgaaaaaatgaactgatttttcttttttgatatgtaatttctttataggttggactaaaattaaggaagggcaattgcgatggtgtgagctcatatttcacactcgagcaaagcatgtgacatttatctgagaatgaagttacatgcactctgctgaaaatgtgaagtaaagttttgtgcggattgattgagcaagaccaactaccatctctttgcaggatcatgggttcaatgatgtctctctagcctacgttggagttgaatttctactcttcttgcttatgtagttgggttgggtgtcctagaagtttgcactgtgaatcattttgatttttagcatatagttgacatgtgtaatggaaatttagatatgtaggacataacttttatacatatcatattgagttgaatggtttaaaagaataaatgttaatattttcatatttacattttatattagttttatgctcacacattttaagttaaaaggaaaaaagttttactatagaaaagtagttcaaaatatatatatacaaaaaagagaatgcaaaaatatatatttttaaaaatatttaaatatgttttcattccttcaaaagttgaattgttttctttttattccactaaatttaaagttatttttttagttcttgaaattcacaaaatactcttttagtcctactacataatacgagccaaacatgaaataagaatttcacaattttttaatagtcaaaatttgattttctattttacattttaaattacactcttggtgattaaaaattatcataatcaagttagtaaaaaattaaaaacctatcaaacacttaaaaaattactttaatttttttattgacttaattttaggaatttcaaaccaccagaaaaattatactttaaatataaaatagaaaattaaattatggtggtaaaatttataaaaaaaattgtaaatttcttattttctatttgacttacattttataaaagaacaaaaaaatattttatgaattttaaaaatttaaaaagataatttcaaatttaaaaactaaaaaaaatacacacatttaaaagattaaaaacatatttaacctttttaaaataaacgtgataaggattctatatcttaatattggcgatggaaaagtttgaatatcaaggagtagcattgtttccattacacatcatttagctttgttgttatttatttcggttgttacaatcaatcatgccccaagcccaccatctccaacgtgcctcgagcaatcatcttcacattcacatatcttattattgttgtgaattttttgggttctatttgcattttgttggacatacattggactggacccgagactatgtttctgattgggatttaaatcatgcaccttccaaatttttaaaaatctcaaattaccctttttaaattatatcattttggaataaacactttcaaaatgggtattttatttagtaaaaaatagatttaccttctagagtaggtgttctataacaataaaaaaataatttttggaataggtgttccataacaagaaaaaataatttctagaataggtgttccataatagtgaaaaatagctttgccttttaaaataggtgttccgtaaaaaatagttttgagaataaacgtttcataacaacaaacaataagaataaattccagagtacgtgtttcataatattaaaaaatagctgtcaaaataaacgttccataatagtaaaaaataaattccaaaatagacgttccataataacaaaaaataactgtgttccataataataataaaaggatagttaatattttcaaaacagaaagggatgcaagatacatatatgcaattgctggattcaaatccctttgtgtttttcctatttggactgcctcctagtcctttagattttggatgtttatatattgggtttggtttcattaccattgggctgcatacctacaatatagttattataattccttctctttatggcctctaacactatggttggcagggtaaaatttgcaacttcctttctcttttcagtaacatcaggccattattgataatcaataaaggcttattaaattaaactaattaaaaaaattaaatataattttgatctatgaaaaataggatcattttgattttggtcctttaaacttttttctttcaattttaattcccgtacaatttaatatttttgattttattttttattgtcaaataacaacgttaattattaatcataataataacatttacaattgagtgaattatcatgttattaaagagtatcactaattcaaaacataatttactaaaaacatatctgacatattaattatgtttttttttaatgataaactatgtttttaaagtcttatcctattagttaatattgtgataagtcactagactattaaagttcatattatatcatcaattaacattattaatcgacagcatagattaaaacaaaaaaaatactaatttttatgggaactaaaatcaaaagattttttttaaaggaccaatttaagtctactgatgatactaatatttttaatttgaagatgcttaaaagtgagttactcaattttttttccaaacataagagtcagattcaaaatttggcctccttatcctaattcatctcaaagcactgaatttaaaggtgggatttgcatctaggaaagatagctgaagacttggaccattgattagtctcaattttcaactatttataggctcattttcttatatataaatcatcttgtgctggaatatttgagtagctatgcatagttgtcaagagctggttttcttatcgtttgggaagcatggccctttcaacatcttttcttgctgtagtcataactcctttgtaccagaggaacacgggttgaagtatttcaaatcattgatgaatgaaaatactcatacggtagtggccatgcaatgtcagacttttaatattttagttgagtctatcagtagggagcactcatacggatcaaaattggtaaggtatatgagtatgatctctgatatatactattcattcccatattctcgcgtattagtatattacacataatatctgtatgttgtatgaatttatttgaatgggaaagacaacataatttagatatgtaagaataagtgaatatttatttttggttttaatactattttgcaaattttctagttatgccactaattagttattattcatctaaaaaatagtcatttataaaggaatgatcaatactctttctctgtgatattttcgttttgcacataatgtttaaaaattgaatatgcactatgagtaaaatactcattgacttaaataaatattaatttggtatttttgtttaacataaaacatttttcttcttagaattttagtaatttttttatcattaaaaaatatgaaataaaaaattggggtcctgagtaataattggcatccctaattattataactggaccaagcagcaagtgattcatatatagtgactagaggaagtggtccaaatcgactcccaagatctaaggacacatgcacgaaaaaggagcagtggtggatctaacactctgtactctgtatttgagcaaatgcgaggtaggttacatggcccaaaaaagcacacataattgaaggtgggtccaatctcaagttctggagaggtcaaagtgttaagatttataattcatcagccttttagaaaagctgctttatgaattatgaataatgtttccgcaaccctaaagataaggaggagaacataataaattaagattgtgacttctcataattaacctatcgtacttttttatatatttggagaataatttttttttttatcttttacaaataaatttatactgtctcatattttcaaggatcaaaatagattgtccataaaagtttaacagttaagctttgtcaaagagataaataactgttatattaatctatgtgctatattccaaaagaaaagttaggaacaaaaacttattttctcttttatctctttttcatagtattttttatttctttattttttcatcatatcacttattatatctataataaataatatgggcactgaacttaattattctcaatagtaattggttcatttttataaaaaattgtcttaaaatttatttgaaagataattttccattgatttattgtattttcttttacaatgatagcatatgcctgttaaactaaaaagaaaagataaactaatgaataatgcaatataaaattaagagagaatttagaaaaagaatgtgaaaagtataagaaaaaagtacgaaagtagcaaagtcaagaataaaaactaatttaatttttcaaaagtctataattattttaatgagtaatttatttatggagaaattctatcaacttttaaaagaaataaatataaaatatgttaaaaatgatgttctaatcaacatcgttatcaacatttatatatttttgtctgcttctgtcatccgcacctctttttaaatgtcaaaaaggttgctttcgcacttaattatacacttagcacaagaaatgaagcaaacctaaaaatcgtgagaatgcttcccttaatataggagtataatcatgtgacgtgtttcaattcctttctatctgcctgttttggctgagacatgcatttccttgttaatgtgtgattatatgcaaataacaagtttcaccatatcttcacattcttccacttaagtgctaccttttctactttaaaagtatgttataaaaagatgggttctccactttccccaagttgaatacttacgtggatgccaagattctgtcttataagagttaattttaatatatatatatatatattaaataatgtgatgtgatgttacgttgatgtgatgttgcgtcgaacgtgtatcgttcaatatgtccaatctttaatttctagacttatagtctcttctttaaatttattacatgttcaggattattatcttcttaaattttagttttattactttttataaattaaaaatctcaattacatgttagtgaatactgggacgtcgctttcaagcatgtatttaaggagtcattaccatatttcctttcttaacctcacaaaagtaatgaccggatttctggggtaattgttattcagttcgcttctttgtccacccgttgttaaaaatacaaaagttttaattagaagataacgtcacaaccacctatttttttactattcaaatttcatcctgactaaatatgcttccttggaattgaatatcttcatttcgttgcatccacatattcctttgtcctagtaagtgtgtttgatatgcatagtcttcccgaagcaccatcggggcattcacattctcatgtgttctacatcacttggacaccatcattggtggcccaaaacccaactagccaatttgaaactcatatgaagccaaaagcaagaaagaggaaaagaaaataatgcatatagagccaaaagacaattcatagcttttgctagttaaatagttatgtttttattatgaaatatgatattttgttgaccatttcgcacagtcataaatcacttcaactttgtgtgaacgttgggcaaaatttattttacaaagtttattttagttaaaattgattttaaatttaagtgagtgatgtttagatgctttttattttaaagtaataaaattaatatgaacttttcaccaaagcaaaatgacttaaaactatttcaactcaaactatccattctaaattcaaaattaatttcttagtaggaccgatgtgaaatcaaatagacacataacaaatataataatagtaattttattatattcttttagtaaacacatgcatcaggtacttgttacactcctcccaaagcaaacatggtggtaaggctatagtaaaaatatttaaacagttgcaattggaccaaaatttgatgctttaaaggcttcaaatcttggctccttggcctggaacttcaacttagcatagagcttcatgtagtcttcaaacacaaatttagggtagagctggcttttctcctctgcctctttctccaacaattctggagcagggtagatgatagcatcactgccagggttgtagaatgaggctatggacattctggtcccatcagtttgtgctatcacacggtgctccacactcttgtacttaccattggtgataacctgtttttccacccattagtgtttgatatgagtaattttgttgcatctaaattgtttgtagaaatgtctactaagcaatatatattaaaatcaaccaattaaaaataatcttatgtaccgttttttaaagtagttattacaatagttgataatttttaaatatataataatttatgattgaatggcagtataatttttttttttgcattattggtgagtctaattaaattcatatattaaaagtaataggaaataaatttacctcaagctgatcaccaaggttaacaacaatggagtggcgcatagggggcacatcaacccactggccatctttgagaagctgtaggccactgaccttgtcatcctggaagagaagaataatcccaccggcatcggtgtggggacgaagaccctttaccaggtctgggttggggcatggagggtagttggcaaccttggtgccaaaagttggtcctcttgatccatggaaagccttcttgaggtaccctttctcaaggcccagattctcacacaacaagtccaacagctgctctgctagtttctctaacctcaaagcaaaatccttcatcaccttcctgcaccaattacctcatgttagaatcttgtaaaagagataaacacagctgcagtttcaattctgaaatgcacagtcgtatcttgtattttatttttttggttttgaactcattatttggtgaagtacttgtagatactctaaaagaaattatgaaacagaagtaataatatatatatatatatatatatatagcaatgttcaatcttaaggacttctgctcttatccattttgtcaagtcaaaatcaaggtgcaaattctgtgtcagttatttgggactttgtgctaacttgtatttgtaaaatactgcatgtcatccaaatcacatgcaatattgtgtaatgttataaatgttttgttttattgtaacctgtactcatccatgagatcagggatctctgagatgtttgattcagggaggtgacgcaattggaaggtgctctcccaatccatgtccttgatttcagtttggacagcatctagacctttgcttgccataaattccttgaacctctcttccatgcatttcctgtagtgctctttggtcaacctctccatagtgtccaataggtcatggggtatgccatgattcaccagctattagaattttgaaagcaatcaaacagtaagaagagacattattaagtaccaagaaaaatcacaaggacatttatttggtgggcaatgtagaaatgaatgaggtaagaacaggttcttgagatacctcaaagaatccccagttttcacaagcatcctttattttctccatggtgtcgtttctctgctcaccattgagcttctccaagttgatcactgggaagttagtcatcttttgaactcaaaactcagctcttttttctatctgcctctttctctattgcagtattgctctgtgcagattagagtttgctagggtggtatttatagaccttgagaatataagaccaaccacaaaaaaagaaaataagaaaaatctcgcttactaataaaaagaatatgttgtaatttgctttctattcacccttgtttttaatctatgatttttatcctatagaacaaccttttctttatggttccgtggttgaattgtcctgccactgtggtatgtaggttggacccacttggtggctgatttgacctcttgacaatttgaccaggactatacaaactgccaccacctcctatcaattctcaaatattttacttcgacctttatttttgggtcatatgaacgtgatttctaggaaggagcttagccaaaggagttccaagattatggtatccacgttttagaataagcttggaagatgaatttgtattcctctccacgtgattaattacttgcatatttttcctaattaggagttgcttgagccccaaaaattggtcagatatggaatagttactaagggtgttgtgtatgcaaatattcggttaatatttcatctagattagaaatttctaaattaaaggaggctcacgaaatataaaatgttttggcgtccattttactcaatcaagcaagttcattcttcatggtgcatatgtaacaaaaagaaaaagaaaaaaaagaaacacaaaagttgtggtccttcaattcttaattaagagcttccgtgtcattcctatccatgatttagtcatttgtcaaacatcttttttcattttatgttggaatcttaaggtaactttatttatttcctcctacggtttcatgagaagtaaaaatggatgaggagataaaacagtatataagtagcattttagtttggtcacttagagtaatagatgaggataatcttttaaatgtgaattttgttgaattattaaaatctgtaatgcgtgcagaaattgttgcttaagagcttgagtcctgaatcacttactgctttcgttgagcaattaaatatcaagaaagttgaaataatatgaataactaattggaacggttaatgattctgaatcagagcactttcttgatgtaaatctccgtaggcattaggaacctagtattgtgaggatggtgagcacggacattgatcaaattatctttgagggtttataagtatcaattaattttatatgcatggaatcctttttctttattattcaattacacttttaattcctttaatttgcattgcgtgtgttttataattagtctttcaagttttttgtgcgtgctcactaaattattcaaattttaaaattaaataaaattggtaatgttatttatttttggctaaaatacatttttagttttttgtattttttttattacattcagtttgacccacttatattttaaaaaaataataatttaatcttttaataacttaataacagaagtaagactattttcacttaaggaatagagcaaagaacgtatttgttaactgattttaacatcgagaagtgatcaaatagaatatatattatacgtttaagttaaagagggtgatgcttggtaaagtctaacctccggcaagatcattatcattttaaaaactcttgtttataactttgttttaactacaaaatcacaaaaagagtattttaactaacatcaccttcacattgtttggttgcatttatattatttggttcacctgccaaagagaggtaacagagactaaatataattaattttaaaagtaaaaggactttaataactcaatattttttttttgaagaaacaaaatcacagctttacatatataattaagacagtgttgaaaatagtctaggaacaattttttcctccaaattgagagtattattgtaaataatttaggaattaatttttcacattttttttcttcatttaatcataataataagtttttacttttaccaaagcctatgtataattgaagatcctccaaatggaaggttcatcctattcaaaacatgtcacatggtattaaatcaaatagtagtattaaattaaaatgtttgtctgtctaaagaattaaatatatgacgaatttaactatattaggtgttaaaatagttttcaatgcaagtatgtcttttggggatctcaccctaatgtgtgtgtctttactttgcaaaaaatggcgggaaagttactgatggctgttggtaatgttcaattgacgctgcatgcaaaagaacaacgcttatttacagttggtcatgcagtggccttgtgatcaaccctaaaaattcttatagctaaaaatactctttatgacaaagcctcctacacattttcatttgcaaaaattcagaaggcccttggaactagggagagtttatcccagtgggttggatgtccagctaggtgccataagtaacgcgccaacaattaattttgatagatacacaatacttttgttttatataaagaatttgatacatacacaataaagtatcctttgcgttcaactatattattaattgtctattgttgacaacccaaaatcagtgtggactaaaaatatttgagtagaacgatgactcgttgtgtttattgattgcttctatatcaattatgtcatttgaaaaaattaacttcaacatagctttctctttagatggatgacaagatgctatcagcgatttaacatgaacgatatcgtttagccatgcgttcaggaaaaaagaaagcagtttttgtctctcttttaaacgtttgcgctaatttcattccattctttaatttagtaatgattgtttttcgctgttttgattacaatgatttaagaatgattcgctatcaattaaacaaagaattgaattatcaaagttttttaaatgaaccctaaaggtcagatagaaaactattcaaatctttaattaatgtaaactagccgccattaaagcctttctttatttctctttcctttctccttttgacgtggctgctcttagtgttagatttagaacaatgctacatccgaaagttgcttgtgatggtttgctgtttgcatgcaatttgtgcttttttctttatatatcgacattaataagagcgttttaacgaaaatcgactttctagcttccttgattaaattgttttactccgttttatgcttctacgttaattaagttggaaacgtgcacatctttgttactagcttgttcattctgcgtccttataaatttgctcaataaatttttatctaacgtttcatgatggaaaataaaataattttgttttgatgacttgtagtagagtggttgatttattccctaccttgatgttggaaccggacgatgaaccaaaattttaatatcaaaaaaatatagtcatacctaatatttattttttaaagaaaatattgtaaaaatccttcaacactagattttatatttgaaagtcgattatatgtaggaattatattaacacttataatgtccgtcataaagagggtacaaaactaagataaatttaaaagcatatttatttttaaaaaaatagaaaagaataatattcatttagaatgaaaaataaatgatggaatttaatgtttctaaaatgggtttggactggttggtctgacactgaatcaacctaatctatcataactcagattataccatattgattaaaataactgacttaaaaatataaaaaaaatacaacttaattttaatagtttaacgtttaaatgagtttgacctgttacgtcatgtttagtgtgcgatataatttttctaaaataagaatcgtccttctttgggaataaataagaaaaaaccttttacaaatatagtatatatagtaccctcacctctctaatgaaaatgttaatcactaatgaaaatttaaaaaaaaaaaaactttttaaactgatttctgatttatttgtagcaaattagtccttattgtgtaaatcaattgtcgacatataaggtgttaataggccttattcaacaagcgtgacactcgttgcctttgacgattcattaattaactagaatatattttgaaagtttttgtgtccatcaatatcaatggaaaccaaattaatgcctaatcaaactggttagtatatttcggttgtgaaacacatgaatcaaattatatactcacacgaataatttctgcttttgtttttttccgttaagaagagaggcagctgcatgaatggctactatttttccccccttatcttgatcataaaatattaaaatgtatgcgttttgcctatgtctcgtgttaaatttacgtatggctgacattttttgcttccgaaagatggataagtatttctacgtacatagtatatattagaaaagccaaacatttggttggtgaaaatgttgataattagggtctattagttctcatcagttttttttttttaattactaatgaaaatttaaaaataaattttaattacttttttcccattaaattattttttaatacttttgatcctattattatttaaatctttaattatatcccgagtttttttaagagaaaaatattccgtgtttttaaaaaatagttcagttgaattctttacttttaaaaggttcaatttaagtattttattatttaaaatagactcaattgatctcattttataaaacaataaaagacctaattgaacatttttaaaattacagtatctaatttaaatttaattaataagaaaaacaaattgaacctaaaaataaattatacaatgacaaaagtaattatgacaaaagtaattaaacaaaaaaagtatatcaacgattgctatttacaaattattgttatttttatataattataaattttaacctaagacctcaactaaactcttcacaactagatcgaccttaatcatttttttatgtaaatcataattgacaaatgtgacttgataataataaaaaattaaaaagtaaaagtcatgtatatcaaatatgaattttatttttcaatataaattaggtcatatttaatatacacaatatatataacaacgagcggggattggaggacgcagaaacatgcatgtttctggctagtggctccaccatcacagtcgcagagaaccactgctgcagtgtgcactcgcaggttaaccctacatgcatgtccaacgtgcttctcagtctttcccaccatgactatgtttcaggtttgcaaagaaaatgcacatctcactttctatgtacccgtttttcctttctaaggtaaatgcgctgtgatatctccaaacacaattctgaacaagattttataatttatcttatgttagccgtattaaatttatcatacattttgaataattaatttggtgatagttatatatatagtctataaatatctaactacaaaaagctcttcatagaaatgttttatttttatttaaatttaaattcagaatttaacattttgatagatgatctaaaacaaaatataaaaaaagtacattcatatttttgaattttttgttgacccgaataaacatagaaaaagacaagtataataatagaaaaaaaattaaagcttgtaaaataaaataaaaaatgaaattaactattcacattatatatttatttaattattatacttatgacaaattaaaatggttaatatatcagtgaagtgtaaggactcatgtactagttaacaatatttcatgttacttttagatcaatttatacagaaacagtttgtccatatgaactaaatagatataccaattgtttccttcttttgatttcttcaactacaatgctacaaaaaggagacaaaaagaagaaagattatagctttaataagcgtgccttttaagaaagcacttagataaatggacatataccacttgaaacacgacgatatgtaaaggcttcgacagtgaattaagcataattaaaacgctataaaaaaaaatcttggactataacaattaaaactgtacatacaaaatttctgatatgtaaattgtaatacactctttatggaggacatttctagtgagagagggtattttattgataaattacattaattatccctgaaatttcatgtaattatacaagcattcatgttttttttaatcataacagttacctctatatactatcccaattatgtaactaccattgtagatatagttaagtgtgcttttcacaagtagttggatggtatcatgagcctatttagttatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatattaaaggaaacttgaagatttattggttgttggatcgaaaatttaacttgataataaactttgatttaattcaataaatatctagcatatttgaatatttatatataaacctttagatcaagattttaatttcacaaccaccatggctgtgggaaaatttattgtaaatttttttatagaaattttatggcatatgtagaaaaccaacgtatgatctcctgcttaaaagtcacacccttttttctatttttcatgcgagagaggtctttttccataattcacattcttgtattgaggatggcggactgcagccaactgaggtaagacaaattttatattttatgccatgcatggggattgaatccaccccgccatgtatggggattgaacccacgccacgaccatattaatttttaacattgttaataatgaaaatttatactaattacaaatgaatatataataagtaaaagaaagttcaattacacgttttgcttgattcaatattttttctctttttacaaaaagaaatcagttgacacaatttatttcataatatcaatagtcttaaattgcattatatttaaagcttgattcaaaatttaaattaaaaaatgcaattgtttaaagatatgaaaaaattgtaatcaatcatcgtttatcaaaatattatataaacaagattgtgatttttaaaataccttaatccatttaattttacaattatgtaaatttgaaaataagtaaaatggaatttcagtaattttttaattttttttggttagttgctttctaaagttgataccacttaataaataaaacagcttgtttatattttcgaaaagaaagtgtaacacattttgacttaagtttactattcaaacaattaaagccgaataacaaatatggaacatatccgaatttcaaaatatatatatatatatatatatataaattaaaacacatacaagtaacgaatacaatctcatgatacaactatacatgataacgattgaatatacaaattaatttttgtatttgaccctctcaaagaaaatactctatttttggtttatagctattatagcgtacaacatcgttgtagattaaaacttctaaacttctacatggttgttaaacgttagtatcaagcaagaggaacatgtacacattagtgtccaaagaacaaaaagaaagatgactacaaagaagctacaacaacaacaatgctaaagggaccagaggaccctatgggtgacattgaatacgaggaaaagactcaaagacaaaaaagcaatgacacaaggggatacatgaagccagtcaaaccattgacggtgttcatttaagtgtaaagagtctcgagggagtattgaattttgtgaaaaaattatagaataattgcacatagattcaaattattacatgtgagtataacaataaaacttaactagaaggttatctaagacaaaaactaattttgattaatttccatgagttatttcagacggacatatactatatagaaattattttgatagtgagattgttgtggggttaatagagtggagtcatattgtaattctagtttctttggttggtgataatggtggttgattgtcatgactaatcaccaccatcaatgacttctatgatcttattcttcaatcctaaatttcttcatcatagtatcttcaaattgatataattcagaagatcatagtaaaaaaaaacattaaaatatcattttccagcaattaatcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaataaatgctatggacagcaaggaatcaatagatggaaaaaagaaagaagataatggaaattgtacttttggccgacatgatagctagagaatcgaaacaagtattgttttgtttttctttggtatccaataaacttgcttcacattttggttggtacaggcagaaaaaagagagagaaaaggaaaccgaagatgaagtgtatgttagaatattttcttttatttccttgttccctacagtttaacaactccgattgactgattggttgatccataacagcctcgaagatcattaatcactaactctaaaattattcttcccgtgtgacctagaaaaagtgacataataagtgaagttgaagtatctaattctttatttattggtaagatgcatgcaaaaaataataacgcactgtgaataccacatcttcctcttctattagtaattgaaactacataaatacaacctcattttttgaagctccactttgagtatgaatcctggaaatgttgacgaggaattgcccttcgattcatcagcagatgcagacaatctggctgagtacacgttggaaggaaaatgggaaacggttatagacatgttttttattttattagtaaagaaaatcgaatttatatataatctttttcctcaatcattgaatcctccttgtatctccaggttatccgcttgtacaatgaacacccagagtgtcacaccacaatgatcaacgagtccgcgggcactgcgctgcacgtggccatagatttgaacgaagaaggtgtggttgaagagcttgtgaatgcaattatcaatcacaggcagggtgagcgaagcgagaagatcaacgctctggtaattggggacgaccacggagatacccctctgcacgtagccgcgtccaggggattcgcaaaaatatgtaagttgatcattggaaccgacaatgaaaggatgtatttggcgagtcgaaaaaacaaacatggggagacgcctctgtttcaagctgctatcaactggaagaaacaggcatttgcttatctctctaacatttccaacaacagcgctcccgtgcaagatcttgagcgccacaatggagacactattcttcactgtgctattaggagagaatatttcggtatgttatacttgtatctatcttcctttgctgctaaacattcatattttctgctttatgtgccacggagaaaattactaatattcacatcacaatattgatggttccgagcatgtcttgttggacgtttatatcagtaaaccgcccatgatgttaaaaatacttgctttaattttcataaattttaagatttggacgtgattttgcaagaaaacgagtggatcatatatgcaatccaaacacctataataatttcttccgcaattcaaaattcttccacgataagtattatagttataatgtaagaattaaatatgatgcatgaacactatcatactaattaattgagaccaaaagagaaaaatgagaataaaatgtaagtatgataaatgatctgatgtgaagtgatctgacaagatataaaaagaagtattgcattaatgtatatgataaatagttatttttattgagttaattattgttgatctaatggtggagggttcaggtacatggaggatttaggtaatttgcatgaattcttggtcaatgcacttataaggaaagaagagaaaaattgttgaaaatatcaaataatgagaggggagagaatgagaaaatcactttagaaattatagtttttaatttatagtagattcattgatgtgtactaaaatcataattcaaattaatttacgtgcactaaaattagagacaaaatgactatatattcatataatttatcaaataagaattaaatttgacttttttttaaaaaaaaatccaagttcgaatgattgagatttattaaggatcatttttttatttttttatttttagtaaattttaaataaattatagtttaatttaaattcagcaccagcatactaattttttaaaactttattttatatttttaattttttaattttgaaataacagtacgctatactgattactatattgttatatatggtgcagatttggctgtgataatagtgcactattatgattttcttagcacacataaaaataaagagggattaactcctctcacagtccttgccactaggccgtcagccttcagaagtgcaagcaaactttcatggtggaaacaaatcctgtaccactgtaagtaatataaactgcacacatcactagctagagtaaacttgtaatataaactgtaaactcaaaacaactactttcacacatgcatgagtgttatttgtaatgttttctttaaataactttaatagaaaaattgtaattaatgaacattgtatttcaattaatcatcaggtataaccaattttaaaatatataaattacttttgcacagtaagtgtatacagaaaaaatgtaaaaccaggaaaaaagatatgatgagaagagagaggggtgtgaaattagatgaatggtgtaatggagagataaagaaaaaatattgtaagttttttttttttatgaatggaaatattgtaagaagtatcgcaaaaacttatattacatgaattatctaatttttttaaatgtgcacatttatgaatcataaatacgtacagagaatgtatgtaagagttttatctacctaaaaaatatatttcaattgattaatcataatgcgttaattattgtaaatcttgaatagtacttatgttttattcttgtagataattttttttatctactatataattttcttcttttgtcataggtatacttgtagcaccactggagcctgaaagtcaaatgaaggagaacttgagaaagatggaggatcctaagtctgataaaatgaattatccaaagaactacgccacattatatgatttctttgctggatcgttgagtgttgctgctctaattggtatgtaaaggggttctcatgcatgcttcccgtcttttttttttctttcttcttttatctcatcactttaatgttttctttactaatacttaatatttactgaaacatattttattatatgtgttcatagacattggttcatttcagcaaaagggataacaatttaacttgatcataaagaaggaagcttatgatcagtgtgtttcataagacaaataagttagtttctaatttattagaatagcttaaaaacttattttactcaaattatagagttgcatgataaaataacttatttcattataatgtttttgtaaaaactagttggaacatttagatttttttcttcttctcatttttgttttttgttttaggggtactagtttctcaaaagtctatctatttcttaagcatttttcttttggtcaggaaagatgccttcaaaaaataatcagcatgacgcagaaaacccgtcaaccaacaagtgtacatttggatttggaactggtcaggttggatctttaccaccaaattatcaaacctttcaacaatttgtcaggtctgcatatgtacatactcttggtctttcaggagcgggtatgtatattctgaatgttaattttttgatccattgctagcttactagctagttaaatattggtcttgggcaagatggtttaataattaacacacgtacgattgtttttgtttcattgcacttgctttttaagaattaaaggacataaagaagacaaaaaagaggcatcaatggagtggtcaactcttgaaggcactactgaaaaggccttatgcagcattcacaggaagcgggggaaaaccaactgatatggaagttgcaccagatatgtataatatttatagccaatataaacaaggtatgtatgaatgtatataacacggagaatgtataacctcaaaattaagaggattaacagttctttcacatttgagttagtgttttatataacctttaatggtttttacaacatttacctgtgcttgtttgacttggcattggtaggtgaacccactgaattggggtggttggaagaagaaaagaaaactgaggctgatgacaaaaaaaatttaagtctaagtgagacaattagtaaggaaactgatcaacttgctgacgagaaaaacattgataaaaaggagacagcatttttggttgcagcaagaaatggcatagttgaaatggtgaatgaaattttagatcgaattccaagtgtcatccacagcactaattcaaagaaagaaaatgtgttgctcgtggcagtgaagaacaggcaacccctagttgttgagagtttgaaaatgaaatcaaaacctgaagtttggaataacttagttctggcagtagatgatgatgagagcaccatgttgcatttggcagcatatgctccaggcggggataaacgttggcagatagctggttctgcattgcaaatgatgtgggatataaaatggtttcaggtatacccaaaacactttttttgtttaatatataatataatgttatatactgtagactcacaatattcagaagaaaaaaatgaagaatgtaagccttattttatagagtattgggttagggaagagaaagagtaagaaaaagaaagtgatagatgggtaaaaaacgaagaaagaaatggatataaaattaggtatatagaaatgagagggaagaaactatagaaagagtaaatttatgaaatataattaaagaggaatgttaacaatatatttctcaaaacattcatttaattattaattgaaatttgttaaaaaatacaaaattataaaataaaaaatcattaaataaaataaaagacttatattttttgtaatctataaaataatgcattattagcatttttcatataattacaagagtaataatacttacatgtatcaatatctgttatttagttttatctcttttattatcacatcaaatacttattacatctatatttttataattattttttctttgcaaaacattttcctaattataatatttatactaatgctgatgcttttgtttgactttggtgcagtatattaaaagccttgtgccacaacacttttactttagaagcgacaaggaggccaaaacagctggggaaatctttgaggactcacataaagacctcataaaggaaagtggtgactggttgaaggatacatctgaatcttgttctgtggtggctgcacttgttgctggcgtttcctttgctacagccagcagcgtccctggtggaaccaacgacgaaggtaagcctaatttagaaggcaagcctgcattcgatgtatttgccattggttcactcgttggactttgcttctcagtcactggactcataatgttccttactatactcacttctcgaaagcaagccaaagattttcgcagagatttgccactcaagcttcttcttggtttgagttcgcttttcgtatccattgctgcaatgtttgtctctttctgcaccggccatttttttctgattagtcacagatacaagatggtcctataccccatttatggagccacttgttttcctgtgactttttatgctgtggctcagtttccgctatactttgatcttctaacggccattttaactaaggtgcctcgggcaagtgataaaggggacaagttataggagcttctaccatatcattgactcagtgtggttttggattcatgtaattgttatacaaatcttttttggtttgttccttttctttttgagtcacgtttttgtttgtgtggtgtgcatttatttaataatatagctatggaaattaaaaagcttttaaattgtagcaaggctgtgttggttgtgctataaagtttgcgattgaggagaaaagtttctgcactcttttagggtaatgccttagataattttgatttcaactttaaagataatgttatatacttatactaattacacttattacgaaagttaattaatttaattattagtattaaatttatttataattataataattttttaaatttatttttatataatctattcatcttttttaatctttataggagaggaaaataaaaaatttaaaatattttagttaaaaaaattatttatacaaaagagaaataaaataaaatcttataataaagaataaaaaaattgttgaataacagacattattgtatacttaacttttgagtggcatacacattttctttttatagttaggttggtctgcagcagcaaaattaaagtacataagaaattattgtttaaccaaaaatttctttaattgtgtaccattacttacaccaattcggcaattctacaaacagttttcggtaacagtagccagctaattgcaacatcattttctttttattttcaaaaatgaaataaaaataaaacaaatattagaaatctactagaccaaaaaaacattttcactactttatataattaacagagataacaaaaaaatgtcattaatttactaacagagataacagataaagcgtcgagcttgccttcatggatataggctttctataacagatctcttttatctagagactcaaaattattagtataacattgtaggtttgtattatagacaattttgttattcagaaaattgatgtttatatattatcactggctatatcatactgtttataacaatttacacttttgtttgtgcttttaatttattttgaagcaagctgtagcaaagcctctgtacacaagttgatgattttaattattttaccttggaacagtatattaaaagccttgtcccacaatacttttactttagaaccaacatgaagggcaaaaccgcaggagaaatcttccaggatgcacatgaagaacttagactggatagcggtgactggctgaagtacacatctgagaattgctctgtcgtgacggcatttgttgcaagtgttttgtttgctacagccagcaacaatatccccggcggcaccgataataatggtaaccctaatttagaaggcagtcctgcattcgatgcatttgccattgcttcgcttgttggactttgcttctctatcattggactcgtaatgttccttgttactcaaacttcttcttgccttaagttctcttttcgtttccattgttgcaatgcttgttgctttctgcattggcaattatttcctgtttagtaatttcgaacacaagatgatcatcttccctgtttatttcagccacttgtttttgtgtcactttgtacgtcgtatcacagttgccgctcgatctacgttgctcttcaagcagtcaattttgttaagatgccactggttctggtgaagaagacagtttataggaataggaggagcttctaccatatcatttttagagctgtattatattgtacttaattcagagtctggtattatcatatcatcatcttcagcaaatattttttatttgatttgtcacttttccatttcttgtcacgtttgtctttaagcagagattgtggtgtgcatttatatatatatgtatatatatatatatatatatatatatattataaacaacttttggattgtagcaactttgtgtgttggttgttgtggaatttaatgtttgcgattaaggatagaagtttctgcacattcttgtcacgtttgtgtttaactaagcagtgttggtttgtgtccaaatatattattcttaatttaaagttgacactcatagctaccgactcagtccgattcagagtcagcaatttttagcggtttaaagtcgaatcacatgagtttttacgggtatatttgcacttttgatctgaatagctgaccgacctggtcactaatcttggtttaaccgatcgaatcggtcagttcgatcgatctgtgttctaaaactatgattttatacttaatttttgtgtcacattcacatttccattgtaagagctgatcctatgagacttttggtgccttggacgatctaattaaaaaattatgttttcataattatttgaatattatttgtatttttttcttgcaaaattattaataatatcttcataatcaagattcttttaaaaaaatcattttggtagaaatcaaaagcaaaattatttaagcaaatagaattttaacaactttaatttcaataaaattatttcaacaaatacaacattaataagaataataatattattatataacttgtacatgcattaaaaaaataattaaatatctttaaaaacctaatatcataaaacttgacttcgattcaattatattgttaaaatttctccatgcatttcctataatgctcttttgaaccgtctttctatgagtataaaatcatctttgaacagcgcttttatagtagtgaacctttccatcatatctaaaaaaggtcaaggggtattccattattcaccaactacaattcggatatatagcaacataacaaatatagttcaaatgaacaacatgaagaaatttttgggatgtacacctgcaaatgaacacacacacacacacacatatatatatatatatatatatatatatttcagtataatataacaaagctcacacacacatatatatatatatatatatatatatatatatatatatttcagtataatataacaaagctcacacatatatatacatatatttcagtattatataacaaagttttgtgagcttgtttgtggggtacctcaaaatatccccagttctggcaagcatcttcaatctggtccagtgtggctttcctctcctcacctttgagattctccaagttgatcacggggaagttgtccatctctcgcactttttatttattttgttcttatgagaattcgtaatgtgtttgttgatgcatattgagatgctaggtgtctcatttatcaacattaagaacacctttaatttaagttaattaggatcgatcataaatgaattcaataatagatacaaaatgattaaaacaataaaaaaggaaaataagaaaaagaaaagataaaagaaaagaaggaaaaaagaaagagatgagagataaagagaaaaatcattaaaaatagatcttttgaaatataaagataacaaatggtctaaccttctattaagtttataacttttttttattttatcttaaaatttattgtccgtcaatctatatctcactctattaaatcttgtttaactatctttctcccaatagctttctgtctacttttttgtgtcatttatatatagaaatgaaaaaagagttaagtgatcacaacattgacaaattaaaaattctcccgtgtgccttatgaatcatgagatgcatgccacatgatcattttgcatcgttgaattgtctacttttggtatcgttggactcatctatggaggcgaaacaacaacttccttgcattttcccttaaattgatactatggtgtttcagcacgtggtttcttcagtaggtggcattacctagcaaatgaagttctaaaagttattattatatatattatatgtaagctggtgaacgatttattcgatatctaacaaatacttaagtaaaatagatctgccatggtattattgtatttgatacccacaaaatttacctccatctaaaattgattactatagcctacaactacaacttacaagcatgagaaagatttcatattgttttgggctgaggttctaccatgtaggggtgtttatcaatcgatccaaaccgatgcaaatcgcggtgaccgaaccgaaaaattgataaccgaaaatcgaaaaaaaaaaacaaaaattttcattggattggatcggttttcggatcggcgggtgaaaaccgattcaatccaaaccgatccaattataaccttaccttaccctttacctacttgggcctatttcctatcatagtccaaaaaccaaaaatccaatacattgctccttattttgtctaatgaacgtgtttgtccaatgaaaattagaaaatgatgtttgtttttgttcaatgaatgtgtttgtttatgctagatactccttattttgataaaaataattctaataagttttatttttagactttttaaaaaaccgaaaactgatccaatccaaaccgaaaaaaattggattggattggatcggatttgaaaaaaatttcaaaccgaatggatggtcaaatgaccaaaccgaaaggattgaatcggatgattttttgctttaaaatcgatccaatccagaccgcaaacacccctactaccatgtaattgtctttcattaattttgcatagcgtgttcgattttttatttcaatgtgatttttcgaatttatgaagaattttatcgttatagtttctaaaacgttttcttaatttctaaggtgtttcccaaacacacatgccattaattgaataagtaagacaatccagaaaataattagaaccaatagcttacaagttattacaagcacgaaaaaaaattaattgaaaattatatctggacaatttcttttttcaaaaaataaccattgatacaaatttaaaaagaattaagaaatatcattatctgaactagttgcctttttctattcctagctttgaccactagagcaataggagccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaactgtggcgtctaactgataggacatttctgttctacaattccaagtttttgagaccaatgggaagacgttggttttggtcagaatatatcttggccatcgcggtcagttgatcatctttatcatgttttttgttcttagcaacaaaaaaaaaatgaattagtccagcatttaaattgagtattgtcaaaaaaactatggaacaccggaggctgccacggtatgcgtaccttgtacgttattaattgttgagactgtggaaatcataatttttaaaattgaattagatcgtctctcgactagtctgatcgaaaacctgtttacgtgattgatcttttaactttttttttaaaaaaatttggaagattttaaaactggtaagaatcattcaaaaatcgattaaaccggactaaatatagtgaaaaaaaaagggtcaagaatcgatacagatagataattgatttgaaccagcattttcatttttttattaatttttttaaattaaaaatatttaaagataaacaaaaatacaatttaataaaaatcaaaaataggtgcaaattaatttatcaattattattaatttcttcttataaaacatataatttacttatttatatgaatttataatttttatatcttaatttcctaagattttatattgtattaatttgtcattttattatttattttagatgtaagtttattattattaactgacattttgtattttactaaaatttaaacttaagtaatactatttgtttgttttatttatactttgaatgttataaatctataaaatttatttaagctttaattttttttttagtctatgtaatttggtcattttggttttttagtcctagaaaattatttcagtcattttaatccctaattttttttgtatttttaattcctatcattaacgtcagtcccttaaaatactacatggcaaagagtgtaaaattatcatgtcatgtgttgttcacatggctctatttctgtgatctcttttgttgacgacattttttccaacacaaatttctaacatgtcactgagaccaacaacaattcttttattcagtcattatatgacttcaattgaggcctaaatcagttcgtattatggtagcttttgctcaaaagtttaattttgaaattcctaacaaaaactccaagcacatgaacatgattagcctaatccaactcaatctaacaaaacaaactctgcagcgggctaactccagattgagaatcatcaaggagtaggaaaacctgaagcatctctgcatatgaagtatggaacaaaaattttagctcttttctctgctttatatctttttcccactttagctcagttacagagatcataacaaggcgcaaaaaagagaaaggaattccacagctacgaatgcaacattccaaaaaaggaaaagaaaactgaaggtgtgttgcacgacatccatgataactgaagtgtgttgcacgacatgcatggcaacattccaaaaaggggaaatataacatgcacgacatacaagaaaaaagataattgaatgaaacaagcaaagtaattacgtttgatttttctttgctggtaattagctacagtttcattggtctcattcatagcagtctcgatcaacgaagatgaatactactaactaaaattattcttcccgtgtgacccgcgaatatttcggtatcttatacttgtgcggggccggatatgttatggcccttgtgggaaacaataaacaaggatctcccatatatttaagtattataaaatataaatataaatttcataaaaaaataagtacatatttttattaaaaattgtatgatttattgcatttaactagtgattaacaaagttttaataaattttaaaaatatgaattatcttttttcttcaactaattcttatatacacctagaaataatcaaagtttgacatttactactaaaaaatatacttttaatatcattttttaacatcgattttataaaatctgatgtaaaaaaaaaggacagtgacataattgtaaataggttgattttgttaatatcaatttttaaaaaaattaatgttgtacatcgatattaacatatggtagcaaagtataatggtgaacatatggtagcaaagtataatggtgaaattgtacaggaacatgggcaaaagataggagatgatttacatgtatattgttcatgctttaactaaacttatgttataccaacgaaatgttctatcaggaagagacatgcctatttgatttattttttaaaagcttattggaaattgcatagagcgtcttaagctaatttagatggatgtttttttaattttcacccccatcttccaaaaggaggtacttttgttcaaggaccaactattctagaagcaggcacaggtctaacagtggttttatagttaatacacccttcactgaatagaacttttgattgaagtgtacaacttgatagcacatcaaagattggagggtcacaagtcatgaaaagattttctttgaacttatattgttttgtgatatcattctcgtatatttgatgcatacaaacatggtaggaggtttgaaacttagttgaatttttatccttcatttatttataaataaatactttccaaatctataagtttaacttagagaggaaagattatgaacttttttcaacatgtttgtttaagctatcttgcagaagcacctgtagcatgcatgcaaggagaaagttcaagttcttttaggggtatatgctttctattgaatgaaggtgaagatgaacaaaggtagatggttattgctaaaacattcttttgtgtgtgtgtgtgtggtggggggtggtattttggagtatgagtagcttttgcttaatttacttctatattacaggcccttctatatacactgtttgctttctactacctatgttgtctcaaattactatggagactgaagaatgcaaagctttggcttcatgtgtaaaggacttgaggccgtaagttatttctggttccaatgcttatattttttattttatattcttcatttctcctccctttttttcctgctaatttcttttaaaggtggatccgtacgtgtaaatcaacaagattctaatgattggtgtatagtttaatttaatattctagcattcttttacatttgttgcaatggcatcattcaataacattattaacaaagcaggttttttgtttggctaaataaattggatatatttgtagattttagattaatgcttcagtaaattagttgggtcacatgcttttctggttgaggataatgcttgcatctttatggtgtgtgatacaataatgaatcttttattaaaggtgagtttcttatcataaatcagccttattattctatattggttttggttgtgcaaaatcttattgacataagttgcactttttttattctagaaagacaaagttcaaataatgttggatgtatcagctattgttgatcttcttaaagcgttggctcattggtcaggtaccatacttgttagcagccattaaaattagtgtttttattgtgctccattatgtgatcatattcctttctttttcatctacttgtttgcttatgcatgtttaaaaaatgacacgtgctcttgtgcagctgtattagcatgtatatatataaaaacaaaatggtttctatgtcacgttgaactccctttgtaccttagtttataataatgagcttaattttaattcataaacatcttttacattattattatctgattacttgttgttacaacattaaattactaggtatttacattatattgttaatgataatattaatattattatcattattaaattttttgcaaaaagcaacattgatttaaaaccgacgtagaaagtatttttttcgcagagatttgccgctcaaacttttcttggcttaagttctcttttcgtacccattgttgcgttgcttgtttctttctgcaccagccattcttttctgttcactcacaaatacaagacggtcatattccccatttatgtagccacttgttttcctctcactttctatgcggtagcacagtggctctctactttgatcttctaacagccattttatataaggttccaaaggcaaatagtgaaggagacagtttataggaggagttttacccatgtcattgttagagctatattgttcttaattctgtgtggtgttggattcatgtcattatcatatcatgcgagtatttgatttctcgctttcccatttcatgtcacgtttgtgttttaagcagagagcgtggtgtgcatttgtgtaataaacacatattatgagcaacgaaacagcttttgaattgtagaaactgtgttggttgttgtattgtgtaatgtttaatttgcagttaaggggaaaagtttctggacattcttagtgtaatacctctaataatcttgatttcaactttaaagttattgttgtgatttatactgaacttttgtgtcacatttacgtatcatgattatacgggttcgactaacaaagtccagtacaattggtaaataattgggttcacatgttgtaaaggattcgattcctcatcatggaaacaaagaaaactttgtctggcgagacaaaccctactttgacaatctttatatgtcaaaagaaattagtcttgaaggacatcttgttgcaaataaaaaaagaaaagtaaattatatgggtcggtttgcagcagcaagaataaagtttctggtttaagctcaaaccgtaatccatgagttaaaccattgctacaatgtacaaacagtctttgatcgtagcaggcaatttggaaccttagttcttattctcaaaaataatggagtaaataaaagatctagaaatcgactagacccaacaaacgagacaagggaaaaataattcgtaattgcttctaatcagaataattcattatttattaaaacggaagtaatcaaatcacctgttgtaataagaaattgaataattagaatacaaataatggtttccccattgctgttttttttttcttcaaattgccaaatcaataaaatttttctggcagtatattatataggtatagctcctgttaaggtgtgatggagttggaaatactctaaaatgagttcactcccttcatggcttcgaatctgggctccttaggctggaacttgagtgtagcatagagcttcatgtaatcctcaaatacaaattttgggtacacttgttccgtctcttctgcctttgtctctaacaatgctggtgcagggtagataagagcatcactggcagggttgtagaatgaggctaccgacattctggtcccatcagttttagcaatcacacgatgctccacactcttgtatctcccattggtaatgacctatgatattagaccaaaatgttgaaagaaaattactataagtacagtgttatgctttagggacataaccattattgaaagaaaaaggtacatacctcaatttggtcaccaaggttaacaacaatggaatggcgcattggaggcacatccacccattggccatttttgagaagctgaaggccactgaccttgtcatcttgcaagagaaggataatcccacccgcatccgtatgtgcacgaagacccttcaccaactctggctttgggcattcagggtaatttgctacctttgtcccaaaatttggacctcttgatccataaaatgcattcttcaagtaccctttctctaatccaagattttcacaaaacaggtctagcaactcctctgctagtttctctaatttctgtgcaaattccttcattgcatccctgcatcattaactcatctagtttagactatgtcatacgtagacaatgctatgtatcaatcatgttatcatatagttttcgatttgtcataccggtagtcttggctgagatcagggatttctgagatgttggaggttgggagatggcgcaagaagaaggtgctctcccaatccatgtcctttacttcagcttctaacccgttgcttgacactgcctcctggaacctcttctccatgcatttcctataatgctcttttgttaaactttccacagtatccaaaagttcaaggggtattccatgattcaccaactacaatcaggaaagcagcccaattaacatatataatttaaatgaacaagattacgaaaacttaatgtttcaaatgtatagatataaatttgagttatgagtatgacagagcttttgtcagcaagtttgtggttgtggggtacctcaaaaaatccccagttctggcaagcatcttcaatctggtgcagggtagctttcctctcctcgccattgatattctccaagttgatcacagggaagttctccatctctcaagctttttctttcctttgttctttatgagaattcttgatgtgtttgttgatgcattttaggatgctaggtgtgtgcaatttataggaatgcaaagagttcagtgaagacaacatgacaaattaaaaattctcctgtgtacctcatgaatcatgagatgcatgcttgcttacgtagttgaattgtctactttggtatcgctggactcatctcatggaggcgaacccaaccttccttgcattttcccttaaattgtagtactatggcatttcagcacgtttaggatattgttaactaatattcttaagatattaattaagaaattaaaagagaaaaataattattacataaatagtaagagaagataaaaaaataatgaataatataatttttttgtttttcaataaaaatatttatattttaaatttcttaattaatatccttactcactgctaggatttatcttttatttattatgaaagcttgtgaactccttattctggcatgtataaaattattaagtgacaatagatctgccttgctgttattgttctaaaattgactagaacctatagcttataattttcaagcataagcaaaatttcatattgttttgggctgtggttctaagatgtaattgaatttcaacggtttctatagcgtaagttattggatttatagtttagatgtagtatttcatgtttttttttttttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtctttcatgtttattaagaagcttgtaattattgacttattgcattctatatttcaaaattcaaacataatttcttacttcccaacatgttttcaaacacatgtttagtaattagacgccattaattgaaaattataactggacaatgtcttttttaaaataatgattgatacaaatttaataaaaaggaaacaagatatatcactatctgtctgtactagttgtgtttttcctttcctttcctttaaccactgtgccaataggagccaccaaacaaagataagctgtggcgtctaactgataggacatttctgttctccatttttcaagttagtttttaagacaaaaaatgggaagacgttgattttggtcagcagaaatatatactatattcctattcctactcatcggcgtctctttggtcttcatcatcatacttttttcttggcacaaaaaatttgaaccaaatctcttacgacatgttaggataacaaaataataaataaaatgatttttagtaagataaaattaacttaatataaattaatgtgtagaaaagttgagagatcagcttctataaattaatttaaacatgaaagatcagtttgtagaaaagtttttctttttcttttaaaagtatttttgaataaacttatcaaacaaactgaactttgtcataagttcaacatgtaaattgaatattgtcttttaaccatgggcaactagaggctgcaatgtgcatgcgtactttgcacgttattattgtgatgtgtgtgaaaataaccaagtgataatgaaataacataagatgctaaaaaaaagaaagtcaaagaaaaacgtgcttaataatacattttatttatttattttcatgatttcgtaaatttttcgtctcctatttttaaaattctggaaattttattactatattagttgaatgttcattatcgttaattgactaataatgtgatggtatttattattgactttatattttgatattaacatgataatacacattacactaatacggatcattgaatggcattattgtgccgatctacatgcagtaaggaaaaaatgtacagaattttaaacacagaaagataaaatatgtgaaaatattcaaaattaagaaattaaatctgtgaaaattataaatggttaaaataataaatgttaaaaatagaattagaatccacagtcttttccaattccactatcacttcaggtactaagtcacttgaccttttttagttctaaataaaaattattttatggatactatcgccgtatttgttaattgcagatttggtccctcaaagtaataactattgtgagaatttaattttgctaatattaaaattttattattttaattaaaaatataatttcgtaaaaaataaattacttataaaaataatttataataatatatccttataaaaaaattaaaattgcaatgatgtcccacttaaaaataaaacacttttttttaaagcgcaaaccctatatttattgtatgaaaaaaaactaaaagttaagacaacaaatttattttaaaaaatatttttattttaattaaacaaatttataatttatacaatttcatttattaagttttataattataaaacttatataattaaataaattataacaatcaatgctcaaacaaattaaactatggagtaaactgttgaaattaactcctcttcgtgtgtcttctcccaaagctcgagagttttggcaacatgctggcctctagagctctatagaagctgtaataaactcctcggatatggtttccagcatcttatgttcgaccttctccatactcttccccagcaaaaaaacaaaaacattctactttgaataataaaagataatggtgtattttatatattaaaatatttttatattatttttttatagtttattaaataagtttatacaactattttttacaataatacttttcatatattctataaataaaggccatttgattgtgctaaaaaatatttatttaataaaaaataagtggtttatttttaagagggacgcgtattttaatttcaattttttttataagaacatattatttaaatattttttatgattgattttttaacagttatattattttaattttaaattaaataataaaaattatattagataaaaaataaattccccaatggttatactttggagacgagtagaatagatactaacatttttatttatgaattaaatcaaacatgtcaaatatattaatttacttgactttgataatattatctgtctcatgataattattattttaagttattttatacagataaaaaataattaataaagaaaagagaataataattttataaaattaatcatatatcatcattaatttatttataatttttattatccaccgttgatataataacaaatataagtaaataataataatattacattaataaaaagttaaaatggtaattattttaaaatatttttttctacaataattataataaaacgggaaagtaatagaatatgaagattaatctcacctctaacaattttattatttattaatttttgtacagtttgcctcttcaatttcaaaaatttgtgcaatttgcctctattcattattattatttatttattttgttgaactgaaagggcatagccccaggaaataaacgaagacacaaaataaaaaacttgtaccatacctcgtggctgtaacccgaaattggctagactatcagcatttcattgtcatgccagtgctatataaaactatcgcgtcaggagtcaatgttaaattactgtgacgaattttgcaaaattgttaaagtaacgaggaaaaatgtgtaattaaactaaaaaattatatcaaccagaaatccagaatagcgtcatgttctagttatacagtggcatattaatcattgaaataaaacgaattgaacgattttattaaagacgaaatctaattttgacaagaactgtctagagaagccttaatatttaatttccttacaaaaaaaaaatggaaatatgctagatttagacccaaagaagatagtagagaaagaacagcagaaaaaaatgcatattatttgaataattttggctatttcctttaccaaaatacaagtaatcaaatcacccgctgtaacaagaaattgcatattaaataaacaagcttaattgctatttctttcaaattttatcagttaataaattttcttcatgcaattgcaattggaagtaatctaaaatgagcgaatggccttcatggcttggaatctgggctcctttggctggaactttagcgtagcatagagcttcatgtaatcctcaaatacaaattttgggtacacttgctctttctcttctgcctttgtctccaagaatgacggtgcagggtagataacagcatcactggcagggttgtagaatgaggctacggacattctggtcccatcagttttagcaatcacacgatgctccacactcttgtatttcccgttggtgattacctatgaatatgatattagaccaaaatgtcgaatgagaattactataacagtataactacaagggctatgctttagggacacaacaattattgaaagtaaaaaggtacatacctcaatttggtcaccaagattaacaacaatggaatggcgcattggaggcacatccacccattggccatttttgagaagctgaaggccactgaccttgtcatcttgcaagagaaggataatcccacccgcatccgtatgagcacgaagacccttcaccaactctggctttgggcatgcagggtagtttgctacctttgtcccaaaatttggaccctttgatccataaaatgcatttttcaagtaccctttctctaatccaagattttcacataacaggtctagcaactcctccgctagtttctccaatttctgtgcaaattccttcattgcatccctgcatcattaactcatagttcagaccatgtcatgtgtagatatgcatcacattatcaaatttgtcacacaaatcacacagttaattaatgcagcattgttttgtcattgttggagtattgataatgaaaacataattatataatatatatgccaatatgccatcaacaatatttcgttatatgccatcagcattgttttcttagttttcaatttgtttttacctatactcttggctgagatcagggatttcggagatgttggaggttgggagatggcgcaagaagaacgtgctttcccaatccatgtccttcacttcagcttctaaccctttgcttgacactgcctccttgaacctcttctccatgcatttcctataatgctcttttgttaacctttccacagtatccaatagttcaaggggtattccatgattcaccaactacaattcgggatatatagcaacataattaatatagttcaaatgaacaacatgaaatttttttgggatgtacacttgcaaatgaactgatatatatatatatatatatatatatatatatatatatatatatcaatataatataacaaagctttttgatcaggttcgtggggtacctcaaaaaatccccagttctggcaagcatctccaatctggttaagggtagccttcctctcctcaccgttgagattctccaagttgatcaccggaaagttctccatccctcactttttttctttcttttttgtcttctgagaaatgttaatgtgttttgttgatacatattgggatgctagctaggtgtgtaccatttataggaatgcaaaagagtgtgcagtgaggacaagtgaaattctcccgtgtgattcatgaatcatgagcaaatgaagccaatctatgccacgagatcattttgcatcgttgaatctggtaccgtttgacttggaggcgaaaccaaccttctttgcatcttcccttaaattgtactaaggcatttaagcatgtggtttcttagaaggtggcataagcaaatgaagttctaaggttttaacagcatttatgttattgttattaattattaatgaacgatttaaaaaactgtgtgaactgcttattcgaacgtctaaagtacttgtgtaacaatagatttgccatccgattattgtatgttgtacactcaaaatctacctccatctaaaattgattacaacatagcctacaagactttttaactaaggtagtttttgaaaactatttattcaaatagtacgagaacaattaataggaattgtcttctgtttttgtcttgtagaggaaaaaattagcctgagtgatgcctccaaagtgatagttattttcaactttttacatcaatcatacatacaatcaaatataaattaaaagtaaaaaataacttacaccgtcatagaataatagaggataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaatttaaaaggaaacaaagatatatcgctgtctaaactagttgtctttctctttttggatactttcaccacttaactaatactaataggagccaccaaaataaagataagctaaataagctattaagctgtggcgtctaactgataggacaattcttaaataagtttttaagaccccatctggaaaacttttagtcaaaatatatatcctgttcatcggggtctcttcagtcttcatctttatcatagttttttctcagcacaaaaaaattgaattaagacttagactcatcagtcttcaagtccaaatgtaaatcgaatattgtcttttaactctgggggaaatggaggctatcacgggtatacgtactttgtacgttatttttgtcacgtgtggaaataaaccataagaatgttagaaaaggaagtgagagagaaatatgtggaccaaaatagtagtctcagcctctcaggttcttgttacacagtgccatctaagtggcgctcgagtcagtttatttttttatttttaaagagaaattaagttaaatatatttgctgaaaaatcttaaaaattagtaacttaatttttattaaggaaagaaaaaatatttttaaaataatttttttctcttttttcttttattttttctctactttgttttagacatttctttcaaatcagaaagatgaaaattatctacaaattctactttaattttaaacttattatttagattcttaatttgaaattttaattaaaagaaaaatacactagacatgtcaggttcatgccattgctggtggctgctcttgacacttgtcaaagttagatttcttctttctttcaaatgggcatcatatagttaaatttggtaaaatctcaataaataaagttatacaaaaattgtaaatgtgtgagtctaaataaaattgttttataattttatggaataacatatttaaaacttaatatattgtatatctaaacatatgactaagaatgaatcatgataataaaaaatattttactcttaaagtagtaaaatattgattttttttttttactatttagggacatttttcagctcttatcactaatatgtaattaatatagaaaatcataattttcaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgatgaaaaattgatatttgtatctgattttatttcaatttcctttctctctaattttgtagaaattagaaataaacaacgggtagatgagtaaccttcaacttttttgtaaaatgtatagaatcaaaaacgaaaaaacttatttttttaatgaatttgttggttttatttttcattggagaagaatgtccgcaatactgaaaaacactttgatgttaaatggtgttttctaagatgttctgatcctcctccatgagacaaatggacatcatttaagtgattttgcaaatgaactgaaatcattcgtctcacattgtatcttatttcctgctcctccaattaaaactctccatctcaattaaaaccctccaatataataataatgtagatgtaattgattgccacttaagtttatgaaagtattaaaatttcaaaaaaccttatttgtttgtttgtaattttatttttatcattaaaagacttacattaaaatacatcatatactagtctatctaagtgacagttaacaatacacatatgaatgacacgggataattcagtctgtacgtaataattgatgacatatgcataaaagttcattcagagatcaaaataacaataatggaattctcacttgtcattcatgcataactaataatatatatataaatatatatatatatatatatatatatatatatataaactagtgatgaacaccccagaccattggcaacttgcagccttaatatttagtttccccaaaaaacgaaataataaaaattattggaaatacaagaggtcaagatacgagagaaagaacattaaaattgcatattatttgaataattctgttattttcctttatcaaaatacaagtaaatcaaatcaaccactgtaaacaacaaattgcatcaataaatcagcaacatttccaagcttaatttctattgcttaattcttttcatattttctcagttaataaaatttattcttgaaattgagcagtcgtaattggaagtaatctaaaatgagccaacagccttcatggcttcgaatctgggctccttaggctggaacttgagtgtagcatagagcttcatgtaatcctcaaatacaaattttgggtacacttgttccgtctcttctgcctttgtctctaacaatgctggtgcagggtagataagagcatcactggcagggttgtagaatgaggctaccgacattctggtcccatcagttttagcaatcacacgatgctccacactcttgtatctcccattggtaatgacctatgatattagaccaaaatgttgaaagaaaattactataagtacagtgttatgctttagggacataaccattattgaaagaaaaaggtacatacctcaatttggtcaccaaggttaacaacaatggaatggcgcattggaggcacatccacccattggccatttttgagaagctgaaggccactgaccttgtcatcttgcaagagaaggataatcccacccgcatccgtatgtgctcgaagacccttcaccaactctggctttgggcattcagggtagtttgctacctttgtcccaaaatttggacctcttgatccataaaatgcattcttcaagtaccctttctctaatccaagattttcacaaaacaggtctagcaactcctctgctagtttctctaatttctgtgcaaattccttcattgcatccctgcatcattaactcatctagtttagactatgtcatatgtagacaatgctatgtatcaatcatgttatcatatagttttcgatttgtcataccggtagtcttggctgagatcagggatttctgagatgttggaggttgggagatggcgcaagaagaaggtgctctcccaatccatgtcctttacttcagcttctaaccctttgcttgacactgcctccttgaacctcttctccatgcatttcatataatgctctttggttaacctttccacagtatccaaaagttcaaggggtattccatgattcaccaactacaatcaggaaagcagcacagttaattaacatatataatttaaatgaacaagattaagaaaacttgatgtttcaaatgtatagatataaatttgagtatgagtatgacaaagcttttgtcagcaagtttatggtggtggggtacctcaaaaaatccccagttctggcaagcatcttcaatttggtccaagatagccttccttttgtcaccattgatattctccaagttgatcacagggaagttctccatctctcaaggtttttctttctctttttccctcttagtaactatcttagtttgtttgtctgtgcagatcaggaaacaatgtgtgtgctatttatagaagttttaagtgtacagtacaattaataaatagtaagtattacaaatcgtgtttgactagttttaaggcatttgaagaatcatgaatggtcgtgatcatgaattttgcgtcattgaattgtcttctttgacgtggccattgaatcctttctccttgttagagtttcttcatgtggtttcacagaaggtggcaaacttcaccagctatgtagaggtgtaaaaactaccaaccactgaattgtaaattttcatagtttcggaaatgattggcctaatataagtttgaattttcttcttcacttgtctcctttacttcctattaaataagaaattatttggttagggctgacatcatttgttaaatattgaaaaaaaatatatattcgttaaaaaaaatcagtagattttggtataaaaaaacaaaaacatgtaccgttcacggtaaaaaaaaattcctacttaagatcagtagaatgaaaaaccttttataagttgatccacccattaagtagattaaaataattattgtatttaacactttttatttttcaaatgacgcaatcaatcattgtttattttactgtaataattttttaaaaaattcattgtttaattggtattacacatttgcactgttatttcacgttttttaattcaacttaatattaattactccttttgtccctatttataagacataattaaatatatattttttttgttttttattataaaattttatttcatttctcttgtgcattaattattttttattattaaaataccttaaaatatctccttctttcttttatggaaatttaagaagataaatagtttttaataaatttaaaaaatattaaattatagatgaatttaatattaataattaaattaattaattttcataaattattgaattatgacttataattaagaaggaatggagtaagatttatatacattatacacaaattcaggagaagcgtggggtttccctaactgaaaaaacgagttgcaatcacatcaggatccattctcagttgttcgccatttaattagaagtcattgtgatgatattgttggatatcatcacagtcgcaacttttgatttgttcctcaactactatcagctcacgggtgaaatagaatttttcatttacttccttttcttatgtcgacaattttttctttatcgcatcctcgctattgttgttcattaaatttttagaagttataagattttatatttaggatttttggatattataaaatataagaataaaaagacataatcttgatgaaatctaaaatttaggatttcaaggtacttaagtaaagagttatttcaaaataaattatgtaaatatatctttgctttagaacacgagaacgatgcatggaggttgaaatatatattcaaggtttttaataaaagaggtattataaaataaatcattaaatacaaatcataaaaatagaatcttactaattttaaggagaactacttaatttcatgaacttagaatgatttttaatctaatttttatattcattttatttttgttatcaagctcgtcttaactaattacaaaaattcaaagagtaaattataattgtacctcctgtgttttgctcaaatttcatccgatactcatccctttttacaccctacaaaaaatcccttaatggtttaatttacattacacttagaccccctccttcctaacaccgtttaataatctaacagaaattagacacatgctggtcacatgacttttaatgaaattttatatctaaaatatcctcatctttttcctctcaacctgaaaatattttaagactcttgtttcttttttgttttttctgtaattggacgtaaaccaactttttgttggatgtgaacctacttttttggtacatagtgttaacacccttccccattttcagcacatcatgatcagtcttaagggacttgttcacacagtcatgtattccatgtattccagttcatccattatattcatgtggtcccaaccatcaacactattttaatcaacaaaaataaacaaatgatttctagtcatccattgtgtttgatgtggtcctaaccatcaacactattttaatcaataataataaataaatgattttaaaaatcataagtggtcccaaactggtcccattgaaaccccattcagaaataaataacaattaaccatcaaaattaaataaataatcttaaaaagtaatctatatacaaggtccagtggtcacttataatcataaccttagcgtgaacagaaatcgtggaacaggaagaagataaatagagcgctcgtgaacgtcgaagaagaagacaaacggaggcactcgtgaacgtcgcgagaactggaaaaggaacagtggagaactcgtgaacggaaagaggaacaatgaagaattcgtgaacttgaacaagaatggtgaataactcgtgaacagtgaataggaattgaacgaatatcgtgagagaaagaggaactcgcaccccctagacgctcaagaagaactcgccaacaagaggaagacgaacagtaaatggtgaagagaaatgaaatgtgaatcctaaattctgaaattaattgggaaagaataatttgagttttacaattaaaatgtaaagaccattttatctgctcacatatttcaattgacattaattaacgatgttaacagaagagggtaaaagtaatgtgtaaaaaagaaggaataatagatgagatttgagtggtgcgagtgtaatttattcgaattcaaattcaatgcatgtaacagggattatctttggtccaatagtccacacgaaatgattaccaacaaagattattgcaaggtgtgaacaacttattggtataattaacaagtaacaattgacttaacaagttattgcatatttttgtttggtacaccgtccaaacgaaattttactttatgttttttaccagagaaattttactttatttattttttactagttaaattttacttatcctgtgtaataaattacactataatcgataaaatgaaaccatagtaaaagttaagtatttttaataagtttgttaacctctatattttacagtaaattttggttttcatctttataaacttttttttttattagttttaatctttataaattttcaaagtttaaaaattaatttctttgatatgtgtttaaataagatatattacatgtcatttcaaaataatagttggtgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatattcacttcacaggggcacataggtggaagtttcttcaatttgatattctaaaaaaattaatttcacaagcaatagcgtcatatcaaagattggtgttaacgttgggctcaaacgggtcagcccatcaagaaaaggagaaaaaacttatgggtctcaaacttcttagtccagcccaaaacaaaaagttatactaactacttaggagttaggagaggaatagtgataaaaatctttgtccaataaagaggaattttagcttagttaaagtttaattgcaatagaattataaaagaaaatattaattaaaataatagcaagcaaataaaactctaacttatttttttgtgtaaacaatcaaaataagaaaaataggatgtcacattattaattaattttagtatttttctaatcttacgcataagtttataattaattttaaaaaagttctttcaagattttatcttagtaaaatataattttgaaaacaattgcagactttgagactactatctattatttgaaataatattatattttcatattagagaaactgaaaaaagagagaacgttgcaattgtgtaaaaaagtaattttaaaatatttaatgaataaaattaatattaacaatataaaaagtaaaaattaaaagaaaaatataaggatttaaaaaaaattcgctttaaaaatcttaaaaataaataaaaataataatgatgattaataaaatataaaatattattttaatataatctaattagacattttcttgaaatattggagcttttattttggatttgtaaaaaaatatatactatcatctaataaaaattgtgcgataaaaaactaataaaatatttttaaaaattaataaacttaacttatataacaatttgtgatttaataccgacaaactgttttatacttttaattctcaattttttctccatcactttccattagtagcataaaaaagttgtcatatactaccaagtactaacacacttttatacagacaataataaaactcacttttcacctttttgctttttttttatagaatcttattaatcagtgtcaatcaaatattagttaaatattttaaaaaaattatataagttataaaaaaatcatgaacagtaaaaaatttcacatcttaatgaaaatatttcttattttattaattgtaaacagggtaaaattaaacttgtcaatctattttctcttggtttagtcaattaattaaacaataatgaacagaatgaaattgtgaatcgacgacgtattttggtgcgtgcaggtcccggtgtttgaattggggtttccgtttcgattgtacctaccagccaacttagggttcagtcactctcgatcacaccgatcaccaacgtggcttctcctcctcaggttctctctctctctctctctctccccccttgcttcaatcattctttctctttttctgttacactgattgtttatattttatcgtatgtttttattttttttttaattttaatttcgtatgttgagggtgcaacttgttgggactgtggattggttagggatctgatgcgtttgtttgactccgatccatttttcgcggttttcgatttccagacactcaacttaatgtgagatttctaggcttgttactcatgtttctattcgtttgattaatataatttgttggatcgtggagattcttcatgaacctaatcccagagaatgaaataaaaataataattaaaaattacgtatctcattgcgcgcgcaaataaaggggaggaatattgtatgcagtcttatccttgcatatataaagagtcaggagccctaaagcttgttttgggtttccgataattgggtaattagtttgctcctcctcacttttggtggcaaaatgaacatgaagtgaattcaaattgagacagacatggctgctgtggtgacaaaggtggatttgtaattgtgaaatatggttttattatgttcataggcgaatggaaatttgtataaattggaggaaatgttcttaatttcgtttctcaagctcagcgtcttgcttaacaagtaataggctattagacttgtcagaaatcaccaaccggattgttctttccaccatggcatgctgagggtcagcttctttttttcttttcaagctagaaagctgtttatgagcaggaattataagattaatagaatggtgtatgcatatagtatatgatttccattcccttttatatgttggcaaactaacttttatttttatatctgattacagaacatggtactgtgtatatcctgttttatactttatgttggataaattgttttagctgttggttactgttcttttgtttatgggcaatactttgtttctgcaggttccctaagtcaactttttggttttttgattgttgaggatggtgctggttttagccatgggggatttgcacataccccacagggcacctgatcttcctgcaaagttcaaatccatgcttgtccccggcaagatccagcacattatttgtactggaaatttgtgtattaaagtatgtccagcttattgaaataactatttctgattcagttttgactgttgccgtgccgcattggaatgtaatcaattgtctctactttatagttttcaacttatattttatgaaagcacaagggacaggggtatgaaggtccaatttttttaacttgccttttgtcttttgacaatgaaatgtttgtcttttaaaaaaatctcgtagttgtaagatttgagttcattcagaaaggttatctctcattacaatgtgtgtactagaacatttagctgtaggacacatcagattttgttttgtcacacccaccttgtctgtgttatgtcctgtgtcttcgtcattgtccatgcttcttagaaagaaaattggactattgaaaattttgtaaaactgggtaatcccgggcatgtgcatggaaggtttgtaatcctgtggccagtggtgaagccatgttaaagcctgatgggatactccttaatttttgtgtagcatagggcaaattgaaagatgttcattgtctcccccaccccgttttcttgttgattgatgaaacatcatattttttttttctgtaacggtgtaaccaaaaacattttcttattcatataaaattggttttcaagtccatttatatgagggaaaccatgttatttatgacaacagaatgggggtttaataatgatttatgttgttttactattttgccattggtatcatgggtactgtcacattcttgtagcataacttctgttcatgcattacttacccccttagtattatccatctgcatctactaaaaataattcagtacatttgttacggttctattttttatatgctatttattttattcacattaacttgcatgatatggaattagatatgtttttagtggttgaatgcataagctaattacctcatttatcttcaggaaattcatgactacttaaagactctttgtccagacttgcatataactcgtggagagtatgatgaagagacgaaatatccagagaccaaaacactaaccattggccaatttaagctgggactatgccatggccatcaggtctgattttgactgatattatttgccctttattttttcttaaatggacctaagaaaattgggagcatggatggatcataaggaaattacctttgatatactagtacaaaaatgaacttctaaaggtcaatgactaaggacttattcgggattaagtcaaaggttttaaaattccaattacaacccacaaaaaggttgatttatttttcacccaatcaaaatttctgtcacaagcttgcaatccaagagccaagcatggcaaatggaaaccaccattgaccctgtactggcaccactcaaagttaatcactttccaatatgctccctcattctagaccccatctagatattattttcttggcagttgataagtgctgcactctgggttttctgatcaaaggtctatgattttaggcaagtataaaaaagtgtttggataggagtagctagtcattcctgtatgttactttgggccttgctacagctaacagctttaatctgagctaaatgatttacttcattatgctactttaggttgcgcttgtgtaggtttatttattctctttcttatcttggttgatggtgcttaacagatgcaatttacatctgttttatttttttgttgcagctgcaactttttccattcaaccatattcctcctgtgattggatttttatgaaactgttattagttatgtttagtagaaacttaaaccgcgccgtattatgtatttttatatgataattatgagtgcttaatggttgtgaaggttattccatggggagacctagactcactggcaatgctacagaggcagcttgatgtagacatccttgtcacaggtcacacccatcaatttacagcttacaaacacgagggaggtgtggttataaatccaggttctgcaacaggtgcctacagcagcatcacttatgacgtgaacccaagttttgtccttatggacatcgatggtctgcgagttgtggtttatgtatacgaacttattgatggagaggttaaggttgacaagattgattttaagaaaacatccacaagcaactctgttcattaaacactaggattttggtcctactctcttttctctttctctttcttatttggctgtttagttttctttttcctccttcaaacttttcaagggtgtattgattttagttgtattttgctttgtatgtacacttgtatttggccatatcataggattttaggatttggtaaatttgtgatctgcgccaaacgtaacgactgattgatcagcaatggctttgtgtattattactccttttaccagttgcccagagatgatatgcagcaaaaagaaaattttattgtaaaaaggtaggaattaagttgggaattgatcactaaaatttggagagggatacaagtgtatatattgtatttgtgcatgtcaaagtaattataaaagaaatagaagcaaaagaaacaagaaataaataaaaaatggagaagaaaaaaatattataatctagtagttatgtttttgagaaaaattcataagaaattgtcaaagtattgttaggaaattaaggattcacaaaagaaagcattaaataaaaatatatttttattaaaatttctcctgcaattaacaagtatattttttaatatgaaataagctaattagtcatacatttaatattacatttttcattaaatgtgtttagtttttttctcttaacacaaatgcttaagacattatactcattatggtttgaaaaatgaaattgcgtgaccgatatctataaaaagtatctaatgtttcttattaaaaatatataaaaaaaattaattgacttaattatatttttgtttctataatttattaaagaaaaatgttagcaacatattctcttttaatactctccaatctttaattcattaaaatttattaaaaataacattctttaaggcttgacaatctatttaatgcagacatcttttatgattttgtggtttccaacgaaatttaaaaagatctatattaattttcaagatattattaaaaaggttattttaatttcaattaaaatacaacatatatttgaagatattattaaaaaatatttttatttaaatttttatgaccaaattaaaaaatactttaaagaattaaaactaaaatttagattagaaaaactaaaattcactaggaataagaatactgcttaatggaacgccattgccttgactaaattttaagaaagaaagaatacattgcatacagttatactttggtttgcgttgtggtaaagtcaatggatcctcaggtttggcacaaagttgcagcgatttcaggtacaatccctttgttatcatgccttcaccatttcatcataatccatacccttttcttcagaaactataactgaaactgaaactgaaacattacaggagtggcagcacttggattgggaacctatggtgcccacgtcttcaagccccaaaaccctgcttacaaagatgtctctttctttctaccctttcctttttcccatttcattttcatttctattgcatcatgaagcttgttttaattggaatctgtttgtgaaggtttggaacacagcttcgctttaccatttggttcacacagctgccttagttgccgccccaattacaaaacaccccaatgttgtaagttcccatttcccaattttcctactttctcttccctttttgcttgcccctttgaaaaaaaaaatgctattttgctattatatggtcattgtagtgtagagtgtttgtgaactgaaaacatctatttgttttttgactcatcaagttatcattttttatttttttgcagtttggaggccttctaacagctggtatcttggctttctctgggacgtaagtgctatctctaccgttgctgtttaaatgactatgtttccattgtaccatagaattctcttccaactatttgtgatgcttattttggaactagagtaattttttatttatatatttgggggactatttttttaacggcggggggtgaaaaattgtagacgggtatagtgatagtgttcccataagttttctcaaggttaactaggtcaagttgagatacatctgttcaggagtcaggacattgtggaagtttatgtttaagccaccaaggtttaaaaggctgagtcattgccacattgatgttgaagatgaatagtttatttcattgtcttggttgcacaataaaagctaggtagggtatcacatatattgtctgaagtattaggtttggactgttggtccaagggatccttggcaaagtgattagaagtgagacattgatttcaacatgggaaggaaaccatagttatcaatagcggtcgtagcggccgggatcacggcggagtgggcatgcaccgctacaaggggtagagtagcggtgcgttttaaggttgcggatgttgcggccacgacggaggggaagcagagcgcccgcgatcgcggtgacgcgtccgtgattgggagtgcgaccttcgacatgcgctgacgatcctctcttcttcgacctgcgccgacgattctccctgctcaagcggccagctgcttttccttctccggcggccaacggctcttccttctctggcggccttgtctggagtcatctctctcttctctggcggctctttcttcttctctgtcgaggtcgagatttttattctctgtttttgtttctttctttttacgacgaagacgtgccgctcagatcgaagcagcggcatcgcgacgacgacgaggaggcgaagaaggtgaagccgaagaaccctaaggtgacagtcgcggaggcggcggcgaagatcgacgccgctgatttggacgctttcctcattaagagatcgatgccgctggtttgattgaagatgatatgatgcgattgtttgatgtggagacagtggagtgcatgacagctttcacccacacttccattcatacttaaaaaaaaataaaaaagttaaattttttgtttctttttatttttatctttttaattctgtttcttttttcttttttgtctttttaattctgttttttttttttaaaccaagtttgatattctctgtttctctcttagttttttatttctgtttttttcttttcttaatatcagattattcattttctttgtttattttgaattttaatttgtgtttgcctattttgaattttaatttctagaactttagtaacatttgactttagagggttcaatacttactttgtagaattgtttctttgacttttattgacatctactattctattttatattttgcttaagcgtttttattgttaatgataattagtgcatgaatttttagttatatttttctttttcagcttatatatttatattatatttttttaatacatatataaaaacgttagaatagcggtcatcccgttatccgctatctcagttttgagggcggccgctctgctccgctatccgggattgataactatgaagggaactactgcataattttgtcctcagaactgaagggaaaactaagttatttatgttaatgatggaatcatgtataattgcttttactaaaccaaagtctgggtccaaactctataaaaatcaaatcactaacttcagagtcagagatgccaatcaagggatggttaacccggtgcttaagaagacgagcagggcaccagttatcttcagagttatgcccatttatgtcatatcatatggttgacacttgacaatgctgtgggatgtgaccgtgtttattattacagggacttacaaccctataatacctcaacaaagataggttgtctacttaggtacaacggtgatgtgagtgtgtactaagattctttaggcgtgtttttttagtggggaaaaggaaatagaaaaactagcaatttgagtttttgactacccaaactgaagaatgaagctgcttgcaaacaggtctaggagatttcaatggtccctatttgtgattggtgagtcccagtcatcccatgaaatacacagatcagagtgagaattatttgtagattgaagtttggaaaatactaacatatttatttgtgatctgactttcattatcttcgtgaaacaaaggagtgcaaagttctagaatttacatcccattgtttgaagcagttatgcattatccaatattagtgtttgtttacttgacttgatgatgagcaggttggatggttttgacttgttcattcttgagaagaagaatattttattctttgaacctctgtagtaaaccaaaaacatacatattttgtgtcagattttgaagtatcttatgtcagatggttctgcaattcacttagaatgtggtctgatgccattttcagctgttgcatatagaatacacttataaattagactagcctataacaatattgtcttgctgcatgctgattttttgtaggaaatattggtaaaaattagaatgatcattaagctgtattcattatgatattgaagtaaatgttgaatttttaggtgttatactgtcgcatttcttgaagacagaaaatattcaaccatggcaccatttggcggctttgcatttatagctgcttggggtagcttgcttttctgatgacatcggctctgcatttgttactaagtaattacactatcactgaatcaactgttgcccagcccatattatacttcatattttgtaaatcttttaccatttgtcttgccaatggtttatgatcatgaaatatatgtatctaccgatgatgctaacagattgaagatattctgttgattgttgaagctgattatgtgtagccccatccttagccgaagtagtagtaataataataataataataaaacaactacttatataacttttagctataaagcataatattccatgtgattgatcataagactaaaatgaatttagcatttttcagttgtgactttggctcctctttggtgctggatacatatgagcaccagctttggccaagaggaaataaattgtacaaattaaatattagtttgaaaccaatgattaagcacaaacgattaatgtgttaaagttaagattaaatcgttcggataatatcttagtttaattcttgtcagaaacaattcttgaaaagagtttatttacttttcagttgaactctggattagttagtgtcctctttttgctgatgaaccttagggttaaaatataaaagaaatagtttgatatatggtgtggttttgaaatgcaaatttaaaaaaatataaaaaaaaatctccttctaagttctacagtaatttttatttttttgtgaattgaattgtatttgttcttaatgctctcttgtgaatgactctcttcagtatttacaattattgaatagggttagattgtatgcatctgtgtttgtaatttcttaaacttaatgcttattactaattttgtgcgcctaaggaattatttttcattattaagaataaaggtttacttgccaagaaattaaggataagttacattagagtattggatgttaatcacaagaagagaactagatgagaaagaaattactttaggggaaaactaaggatattctaatacctacctattttcttctatttttttatcagcaaaacataatttattaaagaggtgaaaagaatacaagatgtatccactcacccaacctattttcttctatttaattttctcataattgtttatttattgtgtcttttttttttaatctagtagaaacctaaaattaatcgatcctctcataatttctgaattgaaagagtatgagttgttaaactacaatatttgtgaagacgatactcttacacagctagtagatttgccgtctcttcaaaaaactacttaaataattgttatcagattcaaactttaatgctttagtatctagcaagtatagctaaataaaaacatttagacacatttatttatattatttatagaattcaatctaatcccgagcattctaaggaaggtatcaactgagaattcaaagtaacaggacaagagattatcttcaattcaatccagtttaatagaattagttgataacttccttaatgacatacataaccaccgtttaccttgttacctatatattccttcatctcactataatatagttcattttagaaatatcgagacttattttcatttatatatgcttacatcaacatacagacgcgtacaaccatataacaaagttataaactaaaagaataataataatttaagaaatattttaacaagaaattcagatatagaatatgaaccgtcgtccatcaacacatttgaccttatcaaatggtccgagtttgtttctgttcatcacctaacaccctcttgaaaaaaatttgaagctttgcttagtgtcttcttcaggcgaagaagactaagtgcacattacagaatcctcctaaacaacagttgataaatccacgccaaagaggagcatgcatcttcttctttttgctataacttgtcagcaaagttgcaaagtattattgtttagtttgtgaacgtgaaagcttcaacatgttaggtggagaatcctcctcaaattctccgaatgcgtcttcgcgattgacctaccatgttttcttgagttttagaacagaaggcacccatttagattttgctaacaccttatgtacttcgttgcagcgaaagggaatctcaactttcagatatgataaacaagtggagagaggatatgtgattttggaaaaactacataaagtaattgagcagtgcctcgttgtcattgttcttctctccgagaactatgcttcttccacttggtgtttggatgaactccacaagattcttgaatcgaagagggagctggggacaccagtttttcctctcttttatgatgtcgttccttccgatgttcgacaccagaaaaataaattcgctgaggctttcgaagaacatgcaacaagacatgaagaagacaaagtgaaggtgcaaaaatggagagaatccttgcatgaagttgctggtttttctggctgggagtccaagaattggtaagttttgcttgtgttattttaactgcatgtataagtaggtaaatatgtttttagttctctaaaatatgtgaaatatgaaattgatccctctaaaaaaaaaattcccatttcagtccctctaattttaacgtgtatcacaactttttttttgttgttaaaattgttatatgaatgccttagacaaaattgttcaatcttatatggcacgtcagcagattcgttaatactgtatgaacactaacatattaaaattttaaaggaactgaaatgggataaaaaaatttaaagggatcaactatttatcattaacctaatagttatatatatcatacttccatctatcattaacctaacaacattgtttgaatgaaaatccatgcttcaatttaacaaacaagtactgaatgtatattggttttagagagctcaacatataaaaattagcgaagagctttgttatattttattgctagtgacacttgaattataataaaattatacattttcattaataggaaaaaagaagagctcattgaagaaattattgaatcggtatggacaaaactacgtcctaaactgccatcatacgatgagggactggttggaattgattcaagagttgagaaaatgatttcacttttgaaactagaattgaaagacgaagtttgctttattggaatatggggcatgggtggtatcggaaagacgactctagcgagagttgtatttaggaaaatacgtaacaaatttgatattagttgcttccttgaaaacgtgacggagatttctcataatagtgatggcatgcttagcttacaaggaaaacttctttctcacatgaaaatgaaagacttgaaaatacaaaatttggacgaaggaaaaaacatcataggaggtatcttattcaacaacaaagttctcctggtccttgatgatgttaatgacataaggcaactagagaatttgggtgtgaatgatcaaaagtggttaggccctggaagcaggattataataataacaagagacatggaagtactaagatcacatggaacagttgaaagttacaaaattgatctcttaaattctgatgaatcccttcagctcttcagtcagaaagcatttaaaagagatcaaccattagaacatctattgcagttgtcaaaagtggctgtccaacaagctggaggccttcctctggccattgagatgatgggttcatccttctgtgggagaagtgaatctcaatggaaagaatttttggatgtgaaagaatacacaaataaagatgttgtgatggacaaacttaaaataagctatgatgggttaccgccaaattataagattttatttcttgatattgcatgtttcttcaatgggtgggtaaaagagcatgtaagacaaattctaactatttgtggccgttatccagcaaatggaattgaagttctaattgataaatcactagcaacttatgatggatcacgtttatggatgcatgatttgcttcaagaaatgggaagaaaaattgttgttgaagaatgtcctatagatgctggcaaacgcagtaggttgtggtcaccccaagacactgatcaagcactgaaaagaaataaggtaattttagttgattttatctcatacaaaagttcaatgaatttatatctttactccttatcatagttaacagaattgaacacactacgttgatctttcatatgtcatgttgagtttggataatctttattaaatccttgctgaacttgaggtttataatgagcttgaaatgtaaagaacctcccttcagtccaaacttttgtaaaccaaaaacaatccaaatcatatatatgccttgagagttaagattgattatcttcagcattgtttgccaggaaaatgaattgattcagggtatagttttgcaatcatccactcaaccatacagtgcaaattgggatcccgaagccttctcaaagatgtacaatcttaaattccttgtaattaattatcacaacatacaatttcctcgtggcatcaaatgtctttgcagttcaatgaaatttcttcagtggacggggtgtactttgaaagctttgccacttggtgtgaagctagaggaacttgtagagttgaaaatgcgttacagcaaaataaaaaaaatctggagtgaatctcaagtaagtagctcaggaaaaatatcaatttaataatagcacaatatcttctaaagctaatcattctcaaatttttgttctgattgatcagcatttcgcaaagttgaagttcattgatctgagccattccgaatatttaatagaaagtcctatagtttctggagttccatgtcttgaaattttgcttcttgaaggttgtataaaccttgttgaggttcaccagtctgttggacagcacaagaaacttgttctattgaacttgaaaggctgcataaatcttcaaacccttccaacaaaatttgaaatggattctttggaggaattgattctttctggctgctcaaaagttaaaaagctccccaacttaggaaaaaatatgcaacatttatcactgcttaatttggagaaatgcaaaaatcttctttgcctaccaaagtctatttggaatctgaaatctcttaggaagctcagtatttgcggttgctcaaaattttctaccttgcccaacatcatgaatgaaaatgggtctttggaggaacttgatgtgagtgggactcccataagagaaattacttcgtccaaagtttgtttagaaaatcttaaagagctctcttttggtggaaggaacgaactagcatccaactcatcatggaacttacatcaaaggatttcaatgcgtaggaggcaacaagtcccgaaggagttgatcttgcctactctgtcccacttaacaagcttgaagttcttgaatttaagttattgtgaccttaatgatgaatcaattccagatagtcttggatccttattatctttgttgggcttaaatctaagtgggaacaattttgttagtccacctactcggtgcattagtaatcttcatacccttcagagtttgaccttaattgattgcccaaggcttgagtctttgcctatgcttccaccaaatgttcaatgcttgggtacaactaatagtactcaaatgaaacccttgaattcagatgcatatatgctgtggaagatctatgagttacatatgaatcagacatactttttatatactcattctctccctactctgccacttcgccacccaaattatttccataaagtgtgtgtttaccaaatggaagatagaccacattttttgttcatcattccagggaaagagattcagaaatggaatgaagagttctttctaattgatccatcacatcatccatataacaggctgggttctgattcagttgcatcaataatagtggatgttcctaactacttagtgtctagtggatggttaggaattgcaatatgcctagcattagaacctccaaatatgcagcactcttgtccatcgcatgtgagtccacatcctgtgggaaatgaggaaacgtgcatatattattgggcatgtaaagttcctcagggtgaacctgacttgactttccccataggacctaaatttagccacttagtttatgaatgcaacgaagagaaatgccaacttcaattgatattttatgtggagaatcattctaagccaagaataaggaagtgtgctagcgttatgagattttgccaagaataaggaagtgtgctagcgttatgagattttgccaagaataaggaagtgtgctagcgttatgagattttgccaagaataaggaagtgtgttaccaattccccttttaattactatttaaaatatataacattctgatcaatagattaaaattttcagttagtaactttcttgtatcaccactgtttatcaattcccattttaatatataaaatatagcgcatgatatataacaccaccactttatacccaatcacctctttggtcggtcactgcatacaatataatttagtatggtttattcccgtacaattaatttagtataattaagtctccttttgctagtaacttaagaattcagcatatacaagtcatagacatgataaacttaagaaatcataataatgcaataaacaagatcacaagaaagtgagatatatggagtttcaaccatccaacagtattcaacctgcatcaatggtctgaattacactacttgttcctatcatgacctatccatttatttaaaaattcttcctcggttgttatctacaaactctccagctagtgttttttgctcggagagaccaagggaaggtttcagaattatattattcaaagaactccacgaaccaaattaaacaatttgttgtatccaccaaagaaggatattcatcttctttgttcacaaaaacatgatatgagctatgttgctttgatggttaaacatcaattgaactattctttccgaaggcgcatgtgcatgtgcatgacaaagcttcaatgttacgtggagaatcttcctcaaactcttcaagatggacataccatgttttcttgagtttaagaggagaagacacccgtttagattttacagatcacttgtatgctgcgttggtgcgaaagggaatcataacttcccgagatgacaaacaactcgagaaaggagatgagatttctcaagaactccctaaagcaattaaggagtccctcggtgccatagtcatgctctctgagaactatatatgcttcttcctcttggtgtttggatgagctcaacaaaattcttgaatcaaatagagttcttggattgaagtttttccagtcttctatggggttagtcctcatgacgttcgacacaagacaacaaagagtttggatgaggcttttagtaaacatgaaagaagatatgggaaagacactgaaaaggtgtaaaaatggagagattccttgaaggaagctggccaaattcctggctgggagtccaaaaattatcagtaagttttgtccgcatcaatttttcatttggatagtgtaaaattgcagtctcttcaaaaaaaaaaatgctagccaattaagtcatattattttaaaattcagcaaatttcatctcttattagtttacattaaaatataattttcaatgaaccaaatgtatcttttgtaaaatttctattcgtacttgtctcactcacacccttaatagatatctattgttggttttagttaaacatacatgtgaaaactaataagcttttcttccatttttattaatgtttaaagtgtgacatgattatatttttctcaaccacaggcatcaaacagagctcattgaaaatattgttgaatcagtatggacaaaacttcgtcctaaaatgccatctttcaatgatgggctaattggaattggctcaagagttaagaaaatggattcaattattctaagcatagaatcgcaggacgttcgctttatcggaatatggggcatgggtgggagttgtcctccagaaaatcaaggatcagtttgatattagctgcttcgttgacaacattagagagatttctaaagaaagcgatggcatgcttcgcttgcaaacgaaacttctctttcataattggcaataaaaggcttagaaattagcgatttggacgaaggaaagaacacaataataaaccttttagccgagaagaaagttctacttgtccttgatgatgttgatgacactagccaaactaaagagtttgactgagaggctagagtggtttggtcgtgggagcagagttataatcacaacaagggacacacaagtactaatatcacatggagtagttgaaaattacaaaattgtgttcttaaattcagatgaatcccttcaactcttgagtcagaaagccttcaaaggagatgaacctcgagagcactatttggagttgtcaaaagttgtagccaaatatgctggagaccttcctttggtcttggagattttaggttcatttctttgtggaagaagtgaatcccaatggagagaagttgtggatatgataaaagaagtccctgccagtcatattgttaaatatgaaatcgcttagaataagctactatgggttatcgtgacgtcagaaaactttgtttcttgatattgcatgcttctttaaagggagggtaaaagagctcttgctctagaaatttgtgaccgttatccagcagttggaattgaatttctagttgaaaaattattggcaacatatgatggctttacaatagggatgcatgatttgcttcaagaaacagcaagggaaattgttaaaaatgttgaataagtttggaaacatactggaagctgctgataattttttttttatatgcaattcttatttatgcttttgtctaggatgggacattaaattattctttatccatgcacttgcatggaactctacaaaaaaaacgggggttttgtccacagaaactgcaacttgaacaatcccatgatccccaaccaaacatatataagtgctacttactagtttgtaacatttatatatatactgtacacacatgcagtttgccaattgctaacattttggactgtcaaattaatatgtagattgtgataatgcataatggcatgggtttggatacgccttctgggaagctagagacacttgtcaattttcatggtatcagtctttaaagagagatatgttcatagatctgttgctgatcttgcttcactcgagtagtacctttcacctcgtggacatagtggcacaaactattatagccagcttcccttacgttttgttcactgtagttttgcatgcgttgcttatttttttagttatgccataagaaacctttcaaagaaagttctacttcttggctactttgttgttgttttggttgaaggatcctcctatgttttccctgaatcttatgtatataaccttctcctttcgccgaacataaatataaatagccaattaagcagcatatattatatagtatagttccaatatagatgttagatatagtcaaattgcgtatctcccattgtacagtaattttgcttttaaagatcctagaattaaatccttattatcctgtgatactgggagtcaaatacttagtaataggtcaaaagttattaaccaggtataaacctgtttacttaaatccatgatcaaatatcacagttcagtgtgttgggttataaaattaattttgaagtgttataatttatatttggatatttttataggaaaagcaaattgatagaaaaacttactgtaagaaaatttatccaatacaaaaactacttaaaaatatgtggaagtttggaatgtggtgcattggcgtcaactcaattattttttttcaaattcacagtaaagcaagtcttagttacttctaatttttcaattatctaccgcaactttggaagccggaatcaattcagctttgtatccaaacacatgcactactttaaattagaatcaataatcaatccagaactaattctttaacgtcaaactaatattgtgacaacatgttgactaatctttcaaaataattttaaagaattcaagatgaaactaaacacactctcaatatgcacacccaacggatggaacagattgtgttgtgtgttctctatcatcctcttttctatggtggggtatctttctgacggacgggttggcttagtatgaccagtgtctgactttctgttggtattatcaaattggtgctgtttttgccactcagcacaaaagtagtcaatctatctacttggtgatttctatgtcatgtgatttttattttatttcagactaattagtgagtgtgttttgttgatttgtttatttttacttggcaacaagaattgggttgattatctgcttcatagttggtaattctatatcttttcaatcacaatcatgagcaagagaactgaattaactgcaatgtatgaggcaattcaaatactagtgctataaactacttataaagatctcatctaatttttcagaagctgacgtgtataaattaattttaattcattaaaaatactgattcatttcctataagtgttataaaaaaatttactgtagtttcagcccgctgttgtgtgcatatgaaaatatgatgtgatgcgtcaatcggtgttggttcttgagttctttgttgttgctgggctgactataaaaagggtgaagaaataatgtttaaaatgtaagattaataaaaattgtattattgatagtaatcataattaaaatgaaaaggtcaaaatacaaaaaatattctagggattaattaaaatgtaaaatagcacatgcatggatgcaccgaattgaagagaccaagcacatagtagacaaaatgtcatatgaccaatgcccgaaatatcatactacgacagtgacagaatttgaaaccacaagatgacatcaaagagttgttgctgtcaaagtaatcatacgatcttcaatatcatcaatgtatagttcccaatatgatctcttatatatatatatatatatatatatatatatatatatatatatgctctctaattggactcgcagcaagaaactgtggcacaagatagtgtccataaatgaatgatttggaaattggaatcactgtgagaaaaaacatggcatgtgacttaattagaggtaaatgagaatttgggtttgcaggaggagagagaaaccgacttctgtaactgagctcgtggttcaagcttcaagaatagatagcccaacacccaccaggtggcgcaccacctactctatttctccactttcaatggaacgtggatttttcttcagttttttttttttttcactctaattgagtcgtgttgttgataaaaaactgttaaactgggatgttggaactccttttgttttgatccattcaaaatctttttttttttttttaagaatcacacaatatatttctattgtgataccatatcctccctttgtttttagaagaaaaaaaaacacattttttctgaataatcatacatttcatgggaataatcatatttgaatttattatgatcatgaaataattatcatgtctgagagtcaatattactcactaacctttggtttagttgagatgaaatcggtgaaaaaagagagaaaaaatcattatttaatatggatgtcagaacttacacatttattacactacttcaattattttattttattttaattttctttctttgtttcattctacacaaccaaaccatatatacctgtggcagtaaaaatggaacacgataataaataaaaggagtaaatgattaagtccgaatccttaaattggcaggagtatgttgcttgtccgatagtattgactattgcgaataagataaagcttttaacaattattaatatagaaatacaaaatcaattaaagaaataaaataatttaagtttcttatataaattaaaattaatttacattttaactatttataagcacaaagcacttacatagttataaattaataaaatcctatattaaaagtcaaaaaatattttatttagagacctctataaattaaaaggttgactattttttagagcaaaagttaatctaaattgacagcatcttagaagagttatattaattatattaatattcttacaccacttttgataacattgttgatgtatctctttttattatatcatatcattcaacatatttcacttatctcttttctccttattgtctttctctgatcattatagaatcttttgcatagttttgatgtaaaaagataatttctcaattgagattaataaaagactgtgtcaatgggattgcgtcatcatgttgaagacatgtatatatacacaaatgtaaataatcatccaatgaaggcttttaccacagaccagaacgtgaggatctacctaaaagaatttgtattaaaaagttagcacttttcagtttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttacataaactagcatacatgcacacatgacataatgtcacaagttaactgtatgaatctttattcacatgggttcaagttccctggcccagccaaggacaaattgggaaaactatttatatggaagaaggtgcactttttaggttgtcaaattgatagtatgatgcagaaaatgttacgtataatttatggccaacttttggacgtctctgtttctaaaaattgttgccattagccactgcagcatgccgaagatgtgaatttcagtttaattctttcctcatctgataaataataacaaactggcttcttaattagtacaataaactgtatttttaatactttaagaaatggtaaaactgttaataatgtgtttagatttccctttaaaacaattaaagtcataattcgagtgaaaacttaaacaaagcaaaacaaaacttatgttcaaatcatgatatatggaaacattacacataccaagagtgtgtttgattgcgtgtcaggagagaaaatatccgttattgaatgtgaaaatcaaaagcaacagacaccaatcactcactaaaatactaattcgccaattgcatcatggggattgaactgtgttaagatattctacatgttcaaatgaaagagggaattgattcaatcgagattcatgataactttttagcaggatttgttgccgatgaactctgcaaatcattaacaagtaaacacgaattatttgctataacctttcgctgttactttatctgctggaagctggctttttcttttctaacggccactttgaaagcttctcttcccattgacacttttgattttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatcacagcaaaaatttaatttctcatttgtaaattatagaacactgtgtcaagaggattatgtcatcatgttgaagactattaaaatgtaaataatcatctcatgaaggctttttttaagagactgtgtatttttttagcaaagttaattttgtttaagttgataaagtaataatccttctaaatatttaatattaacaacatactgacatgaatttaaaattactagttaaattaaaaccatttcatttcaatgaatctaggcgatgagaaagatctatatctaatatgtaatgtaacaaagttcccattaaaaaaatgtatgaaaaagttggcacatttttcacataaaatagcatagatttatacataacataatgtcacaagttaactatgaatctttactcacatggattcaagtacccgtgcggccgtgcccagccgagaacataatgggaaaaatcttatataaaagaaagtgcacttttggttgtcaaattgctagtatgatgcagagaatgtcatgtatgatttttggccaacttttggacgtctttgtttataaattttgttttgtcataagctactgcaggaggccgaagatgaggatttcagttttgttcttccctcacctaataaataataacaaactggtttcttttttggtacaataaactattttaatactctttctcctcatttttacattactcaattaattaacttataatgatgaaggaaattaatttagtaagttagtcgtattgattttttcttaaatttatacattttaaaattttctctaacatttcaatcatacatacttttgtttatttatataaaaaagaatcagagaaaatactttaagaaatgataaaacaattaatgtgtttggattttacttgaaaaacttaaagtcataatttcagtgaaaaaattaaaaacaataataataaaaacagaaaaacaaacaatattttttgctcaaatcatgatatgtggggcattgcactctccaactcgtcaattgcatccgttggattgaactgggttcggatattctacatgttcattgtataaaatgaaataggtaattgatgcaatcgagattcgtagttactttttagcagtatttgtggaaaatgaactctgcaaatcattaaaattgcaaacagaaactattcgctattaattagtctattacctttcactgttaccttatattatgggagttggcttttctttttatggccgttaggcaagtttgaaagctccccattccattgactttgtctccctagccatttgtacaggcacagcaaccaattattcaattcatgattctttaacctattttttatttatttataaatgtaaaaaatacgagttttttgacaagaaaaataataaagttacataaagctggttagaagtaaataattttgcataaaaaataatatttgtattagaaattattatttgaactaggagattgagagaaattggtgaaacgtaaggataacaatgagtttatttctaatgctgttgtagtgtgaatgtgaatatgaacttctatgttgggtcagagtagacaaatttagtaatatataaatgagaatgattcacaaatttattcttttaatgtggtgttgattttatttgtgtactacctccttattatatcttttaattttttaatttttttcaatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaataacaatttttcaagtgcattctaatgccaactttttacttctcataaccacactataataataaaaattgccccaagtataacatgaagcaacagtttttataacacctaaaatatattatagctaagaatcaaatatatgtcatcacaaatactttatacattgttaactattatatatttcctaagaaaaataaattacctaaggaaaaaaacagtaatgtgtaattgtaaagtctccatgctattgcttttgagctattcgttatggaaatcatttttcattttaaaatttcagcaacactgcatgtgatcagcacttagtttttatctcacagaaaccctactcacttcttttcttggatgaaaaaggttccaagttctgaattaggtcccacggtgatgactcacccacccttccaaacaaagctaaatatactgaatggtaggtacactaccctataaccatgagctgcaactttactttataagcaattagtcaattagaggatactctaggtcacctaaattgagaaaatagtctcaccctaagcgtgatttaataacattagtcaaggacgggattaaattttaataaaggtttactttttattattcttaaacatagtttttttatgttatacttcaattaaattttcttccaaagtgaaatgctgcaagttaatatttctttcatataatccttctgaacaaaattttaataggacgcccatgtgatgcagtggaagaaaaaggtacttcaaatataacgaaacctgaagaacaatgatcactttagaaatcacaaaagataaagtctactgcaaagtataaaaaaccttagatacaatttactttagtgcccaaagttaaattaatgtagttactagctaccccattaccagttcacaccaactggaagaaaagtcaacattattaactaacataatccataaccccaaaaaatcttcaaactaatataaaccaactagtaatttatcttctcttcctagtctcacttccagacaacttcccataacatactttacacaaagcaatcagccagatgcatattctcatgcgggaatatctctaccctcttcagcttttagtatccagtaggaaactcgcagctaccataccctgcaaaataacaactttggttaattatgctcacatccacatatccataatttcaactaaaaaaaaaacaataaagtacaattattacaaatttttattaggtttgcgtccatttcccttgtccctttgggtataaggttttcgccaacattgtgctaaacaaaaaagcattttttttcatagaccaagtaaaacaacactgtagcatcgtaattagaatggacccctatagtacactctacccaataaagttacgccacgtcgttatcataaaagattcccctttgtttttatgtccactgacctgtcgtgcaccactcttctcaccccgctcaagttagcagcgcaacataacactattctaaactacacacaatcagaagataaaaaagtaaaagacttaaatatgatttttcatatatgtaatatgtaatattcttcttttctaatttattgcctaaaaaacatttttatttattttacaatctaacaatttttaaacttttatttttagtatttgctgatagttagtttacgtgacacacttgccacattttcacctaacaaataatttggcattctgttaatttatttagtaataaactgaaaaagaaaaattcatgtatcaaaacatatttaaggcaaaataaaaatataaggggtttatagaatactcactaggttcctgcgtgaccacgtacgacgtacccccaaaatagcagctaccaccctttcgcgactgtttctggtaataactgttgaacgcgaacgaagcgtgggccacaagcgtgttaggatcgtaacacgtggcaccgcgctgaatcggaccgcaatcagcacctccctcgccgcaagcgaaatctagagccgcctgcagcttaaccttatccgcgtcccggttcgccacgcaccatgtgttcccagtggtactcttggaaaccccgccgctcacaacgggcgccggcgccggcgtctccttctgctgtccgccgcctctcaccggcgccgacggacggtcgtggtagtccttgagctcctccaccgttaacggaacattgtaaacccccctctcgtcagggtaaaaaagcccaaagtttctctcggaagtgggcccgggcttctggttctcattaaaaagcgcgaagagataaacggtgagatccgctttgggcctgaggggggtcccaccagcggtcaagatcttacgaacaagattcccgttgtacgctgcagcgttctctaggctggcacccacctcattactatcccccttagaaggccaacctgtttcagtaaccacgatcttaacgtcgtcgtatttcaaagcacttagcgcagagaaaacggcgtctatttgggcgtcaaataggttataatatctcaacccgttacccggatccaccactccggggttatcacggaacagcgcgtagtccaaagagatgacatcagcgttcgactcatacgcgaaaaacgggtacacgttaaccattaggtatgacccggtttcgcggagaaagtccagcatgggcttgaaaacgggttccacgagttcgggtcggaacgacccggcagaggaagggtaggagtttgcaagcgcggagagtgcaatgggagaggaaaccttaatgtccttgtcgaggttgtgcttagtgagggctttttggatgttcttcatggcgggtacgaggaacttggttgtgttgtgtgggtccacgaaaacctcgttgccgaccgcaatggattcgatttgcgtgtgagggtagtacgcggcgacgttcctttcgacccatgaggatgcaaaggagggagctttggcggctgcgaaaagttgctggttcggaagatcaaccgtcactttgattccggatccggatagtgcccggagcactgccgggtcggtgtcgtaaactttgacacgtgtcagtccttgggatttgaggagttgaacgaccttcagcgcggaggggaggttgttcgctatgcgaccgtagttaactccaatggaacctccatctgaatcaaacaaacaaacaatgtaggataaaagggttaactttgttatgcaaaaacaatgtagaataaaagggttgactttattatgcaaaaatgaaagaagagaaagagagaaatgaagtggtagaggtgagcattacctgcgagtgcgagggaaaggagaatggtgaggatgatgaagcgatgcattctctgcttctgtggggagaaacagagcgagagagagagggtttgggtttgttttgttgttgacgatgtttctgggaatgtggtgtgcagagagtgtttgtttgtgtggagcaagtgggtgacgtgagagagagtggtgtctgtttgttactatgtatgaagggaagggtgttgaggtaaacatggtggtgggaaagggtaagagggaaagtgggacccaccatccatcactcatggccggccttatgctgctgatgaagttcaggaactggagggatgagcgtttcgtcccaccaaaaagggccttagatcgggatttcaatgtttttattattaaattcataagaggaatgattattgattagtataaggtgatcataagtatattaatttttaaaataatttattattaaataatagtataaaattgttttatattatatataggtatgaaattctaaatttattttttaaaattatatgattatggacactttttgtggtgcatgaattatgattttcggtaggattttgtttttcttttaatgaagaaaaatccgaaaaaaaggccaatttaagaatcagaatgaaaactgactatggcattttattcattgctgtatttaagttctcgacatcacagggaataatgttttgaaggagctgctatcatccgttaatgataaagataaattaaaaaatggtcatactaatttcgtgtacttttttgaactaatggtaaaattcaattttacttcattgtcttgtcagatcttctttgcttttttttttacctttctgaacagcatcttacatattacaccaaagttgggtgtcttacaaatggttttgtatcttcgcttttgcacctaaataatccgtaaagataattaatctaatcgagcctttgcggatgagggtcgaatgtgtagcacattgttccttgggacacaaggtctaacttgtttgccaattattttcttggtaacgtatgagtaaagagtaattaatgactccaatggacatcatttatgtcaatccaaaaataccaataaaattttacttcaaaccttacaacatattcctttaacaggttttttcttttcttttttagtaaattacacatttttcatataatatttagaaaaaatataagtatcatatttttaaaaaaattgtacacatattttttctaagatttaaggaaattatatgtttgtcatgagattttaaaaaattatataaaaatatcttttatttttaaaatctacacaaactctcctaataagtatagattttgatgtactcgaagttagttttgaacaagaactaataaatttaaattttacaagttacaaaaaatagataattttttttcagcgatgaatttcaaacatttttattttatgatgacgaaatatttatttttaatttattttaattaaaattgtcaacgcataagacttttaattgtcaaatatttagatgatatttagggaatttgtataggtcttaaaaatagaagagagatatatataattttcttaaaattttaggagaggcacatataggttttatataattttttaaaattttaaaactttttaaaattttaagatatataattttttaaaattttagagaaaaatatatataattttttttcttttattaaaagcaagatatctcaatagcagaaaatcataaaatgattttttatatgcacgatgagtaaattgaatctcttttagtatacttgaagaaacaagctttttccttcttttatgtaagaaaaaatggagatcaactttcattcagtgcatctttaaataaaatactacctaagtgtcgaacaagcaaagcccacaacttctcagatgttgtttgcaatctctcatcctcctcaaggttcacttcgttttcttcttattttcatgaaaaatcaagactaaaacttagtgacaatttatcaaaaggctaaatgacaacttcctaatcctaaatgacaaattattaacaaaatcaaggccaaacaagtgtcaaaagaaaggaaaggataagataagtgtcaaattgtaagataaaattggcacgtatcaatactcaagtcagccttagaggccttgggtcactgatttacatgattcatttcttgggcttgagcttctcaagtatcaaaggtccatcttttttttttttctctctctttctttggatcggtagaagttgttatgacatttggactctaataccatattgggttcaaccctttacctggacaacttatacttcttcctaagcttatactcaagtcagtctcgacctcatattttgagtgcttcttcatacaccaggccaaatttctcctacaccattttttttataaaaacccgaaaatacccatgctttgatttggacacaaataaatgagatggtgaacagctgagcttcatttgcattgcgacatccgtatggctttcgagaaaaatatatgagcttgggcaacatccatataggttcattgcaacaacattggtgtttattggtggcgtttcattcatttcgggggcttgttcgtggttgccggagttgcagagctgtcggcgaagaaaaaagaggtgagtagggggcgttgtttttttacggattcggtaatccgtattatttatacggattacctaatccgtatgaattagacggattagcagatccgtataatctatacggattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatggtgaagaatcttgggctttggttcgcaatcatttgctcagagaacttggagagtggacggatggatatattgccttgtttggtggcatagatagatttgaaaccttaaagcggtccctactggttgatggattgtcgaaggtaaacctttcatttgtttattcaatgtatgnnnnnnnnnnnnnnnnnnnnnnnnnnnnnnnnnnnnnnnnnnnnnnnnnnnnnnnnnnnnnnnnnnnnnnnnnnnnnnnctttaattcaagtaaacatatatttgaatcattaaactgtatttacagtgtactatagacaagtggatggatattacagacatgggtcatgtaattgcatcgagatataatgtgattgtggtttccctttcactgaagcaaagcatgacgtttttccctctaagaagtcaaccgcctagagatccacacgttcatcgcattttgtgcattggccatgtttttgggaaccactttgtgcaggtaatcctttaatttgtttattttatgaaagggacatcattaaggacacaaataaacgttactgatgttgtgtaattttgttatgtgtaacaggtttttttaaaagacaattgtccattaccgttgactacatttttgtgggataggcattgtaccagtgaagcaaaacattggcctagttattacattagtagaatgcaaatgtatgctaactgtatgaagttacgcactgaacatgtagatttacggtaatgtgtatcaacgtttcaaaagtgatgaatgacattgttttctgcataactgtgtccaaatttgtccaacatgagaaacatcataaaaaacaagctaataaataagtgtatacaaaagtcaaataaaaatcaaaggcgcctccgttgtgcatctcgtggacgtcttcctcgagtataaacaatcccgtggtccctgacactacgggcaacaagcaacatctgtagcgtcctatcatatgcctcggtgccctctgtaacaatcccatcatcaatgaaggcttgcaagccctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtcgttgacaaacaacctgtatttacagtgacaaatacaaacataagcagaatggattcaagtattatcgcacaatgcgcaaaacatgtagattttcttaccactgcatgccttggagactggtgctcctgagccacatctgatgcatcgggaggaactggatcagtagaaggcggctggacagatgccggtgcaaaaggaactggaacagtctggggcccagatggaatatgggatcgggcctgagcatactgcgtcggagtcataaatgggtgtgagattcggaagaaccactccaaatatccaggcacacagtgactaggataatgaaccaagtcaccggtcgatataaggaactccgcgaagtggacccatcggtcgtccacatcgtctgcggagggaacttctgacaaaggcagctcaggaatgtgttgaatctggccaaactgccgaacgaccctgtcaggtaagtacctcacgatgtggggaccccatctgatgaacccggaaaataagctaatcggctcgaactccctaaatggacgatgggcatcgtatgctgtccagcatatgtcatctggcctcaaccggtcgatgcgagcacgataagtcgacaacggtaatgccttcgcactcttccagcgaaaggcacgtggcaaggtctcctcgtacgtatcctccgccgtcccgttgcctacagtcggaaaatgctcgtatatccagcactacaagtttaaatcattatagtcagaagtagtaaaaaaacataacaatttttattaacacagacacatgtatgcaagattacctgtaacaaagtaatgtatccagctagatgcttgccgtggtgttttgatgcataaccgagatgctcatacatatgcaccaaagcaccggccccccaagcaaatcccccagcttcgtccaggtcacgaaaaggttgtaagaactgaacgcctatatgtgtcgcactcttgttggcaaacaaagtgcaaccaacaagatgcaacagatatgccctcgctgcaactatccacttgccagagtcacacatactaaaatacaactctcgaagccaggacaatcgcacataagcgccgtggcactgtgtcgtctccgcttcagcgtcatcaacactgacctctagcagctcgaccaacaatgtgatcgcctctccgatatcaatctggtcgtagtcgtggaagactcccatgacagggatatgtagaagagaggcaacatcgtccaacgtaatggtcaactcaccgactggcagatgaaagctggatgtctcagcatgccatctctctacaaaggctgaaagcaatcctcgatctccagtctcgactgagcaacgaatcaatggactaaggccagtagcagccactaagccctcaatctccggagctggcttcccgaatttaatgaccttacgtccatgggaagccaacttcagctctgcacgttcctgtaacaaatacattcacagatgtttacaattaaccacacagatgtttacaatttacaattaagcaagggtcattgttttataaatacctctcctgaccagactttaaaagccacatggtcggcataggcagtcaagactgaacagtcttccggacctcctggaaaacctccagtccctacatcgtccgtcggaagtatatcagcatcaatatgtggttcctcaactggagcatcgtcacgtggaggatcgtcacgtggaggatcctgaggaacactaacacctgcccgttgtcgacgaacggatgctgtcggtctacgccgctcatccgctccaccaacaggcctatgcattcctcctctggtcctagccatgatctgtacaacatcacataaatagttgcgttaaaattgtaagacaaattctaaccacaaagtccaaaactgggacacacaagtcaaattcacaagcacacagtccaatgaagtcaagttcaaaccaaacagtccaatcctgggtgacacaagtccaattcacaagcacagtgcgcaatcaagtcaagttcaaaccaaacagtccaaaactgggtaacacaagtccaattcacaagcatagtgagcaatcaagtcaaatactaacgacacagtccaaaactgggtaacacaagtccagttgacaagcacagtgagcaatcaagtcaacttcaaaccaaacagtccaaaactgggtaacacaattccaattcacaagcatagtgagcaatgaagtcaagttcaaaccaaacatcccaaaactaggtaacacaagtccaattgacaagcatagtgagcaatcaagtcaaattctaaccacacagtccaaaactggtacacacaagtcaaattcagaagcacacagtccaatgaagtcaagttcaaaccaaacactccaatactgggtaacacaagtccaattgacaagcatagtgagcaatcaagtcaaatactaaccacactgtccaaaacttagtcacacaagtcaaattcaagacaaacagtccaagaccgggtgacacaagtccaatacacaaccatagtgacctaccaaatccaattctaaccaaacagcaaatgcataccgggtgacaaaagttcaattcacaagcacgtcatcaatcaaggcaaattcaaacgcacagacaactaccaagtccaattcagaagcacagtcacctatcaagtccaattcacaagcatcgtcacctatcaagtccaattcaattgctaactatatacaactttcattgacaaccatacttcctatatttgagagttatttgatcaatagcatacaatcaatagcatatcatcatgaagatgttgataacaattgaaaattcaggtgtaatcatttaaaaaattttttttttttaaaaaaaggcgccatacggattgctcaatccgaatgaaccatacggattggctaatccgtatgtgtcattcggattggctaatccgtatgtgtcattcggattggctaatccgtatgttttatacggattgctcaatccgaatgacccatacggattagccaatccgaatgacacatacggattagataatccgtatggttcattcggattgagcaatccgtatatcacatacggattacctaatccatatgtggtatacggattgctcaatccgaatgacccatacggattaccgaatccgtatggcgcttcccctcccaaaaacgcccaaaatgaagaaactcaccttcgactgcgccttcaccaacaccctaccaagtcaccgagcaccacggccaaaaatgcggaaccaccgaagctttggaatcaacaaccaccgagaatcaccacagcaaggagaagaagaagcagacgcgcggaggaggaagagggaatgcgattttcttttaatttaaattaaaggggtaaaaccggaagtacactgtgcattactggtgtaggagaaatttggcctggtgtatgaagcgtcactctcatattttttgctttctctctttctttgtctgttgcttgggcttgtgattcttgagtctcgaaggcctatgtgtttttttaatatatattttttgggtcgatgcaatgggctactacatgatttaggctctgataacaagtaggaattttcgcacagacccaaaattaagttagtgtggactaggttgaattcatatgaaacataagaatgtatcgtccaaaaaattcaaaccaattcgactatgtcctctatgcttatatacactaacgtttgtctttatttgctcaatggaactttttaaagttaccatgtttacattgtagaatttaagatatctaaaagccaggtcaaagtgtttatcagcacaagaataaatgaaatataaaagtcaagaacaaggctataaagtgatgttgtcattcagaacacttgtactttagagacatgattaaatcaaacctatttcagtttatgggctgttccattttgattacccaaaaaatgtatccaccaccaccacgcgcacaaattatcaaacccattggtcgtttaaattttagtaataaggaaaaaaagctgagaattgaaaagtgcctaaaaaaatctagtaatgagtgattgccatgcataaaaaccacaatagtagatcataaaactaaaaaaataatataaaaaagaagatatatcaaacaatacaggataatcgtttcccaccctttcattccttttgcttttgaaaacattattaaaatatacacaataggaaaaaaaatacaactcatagtaccacttgaaaaaaattatttttcatcaaatttagatgtacgaaaatgacattaactaaaaacaaattaagaaaatgaaaacaaaaaatgtaacacacattggtattttgggctatataagtcgaacacgttgtcaagcaatggtgggcctgtctaatagaccttacgaaatgtttggtgcaaataacaacattgtggttggtccatcattttcaagaaaattaatttaccttatttaaagtaaaaaaaaaaattgtttgcttttgcatatcaaatggcaaaaaaatcttcatatttcccggaagatgaattattacgagctatacttgatatatatacttggtatatgcaagtttcaaatgagcatttcataaatcggttatatttatttaatattatttaggttaatagttgagtttaactttgatatattattagtgtaaaaaattatgttatatatatcaaaatgagaaataagtttgtatcatatataataatttttccaatttcctttcttccttataattcaaaatctaaataatttataatcatgagatacataccaaaacaaattcattattcataccatatataataaacatttaaattttaattaaaccttagtgataatataatttttcaataaattgaagggagaaagataaaagaaaaaataattgaagtatgatgaaaaatgttacggatgtatctcggacaaaacaaaaaaataaaaggcccattttccaatatatgcataggcacagccaggactacagccacccagaacagaacaacagttgaagatacatgatgtcattgtccatcttcaaacttgttttgacatcatttcttctctgctttttcttgcaggaacctaccaatgctcttagaaaggcaagtaagctttgcattttattagttccctgattgttttgtcgtcaatcttatggagttttgtaactgttcaagttccaactttgagaatttccctgattttatattttgttggattctgttttcagacctacattgtgtgcatgggaggacattctcatggtccagaccctttgtcttcatcagtataagtaacattgttgttacaatagatgtactagcagaaataaattttcttcatctcttttatcattttttagttattttattcaacaaaacacttttatttttcactttaaatcttactaattttcattcctttttttctatccactctatttctcttctctcagtcagcctaaaagataaaagaatatctatatactgataaaagataaaactaatattttcaggaaaaaaaatataaaattatataattttgtggtattttatgtttaatcttgctttcctttttttttctctctcctataattctttcaggaatcaagccttagtgcaacaccgtttcttagtttttgtcggtcacaatctctttccatgtgataaattcgtgtcccctcctactactttttcctggtttcgttccttgccaccgctacacaagtatgaacaaaagtaataatgggttgaaaataactaatcgaaatagttaaaaaaatataaaataatataaaaataataattataatttatttaaaaagtaattaaaaattaaataaatatattgaatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatcaaatataacgaaagcttcattaaaaattgaaaagtcaatttattaaattataaatgttcgataaaattagttgttgaaataattgaaaaatataaattataaaaataataaaattattatttattaaaagataaaaaattaaataaatatattgcggataaaaatgaaaaaaatataaaaaaaaattgaaactaaaaactagtttaaatatctgttatccattttccaatataagcataggcatagcctagactatagccacccctgaacagaaaaacagttgaagatacatgatgtcattgtccatcttcaaacttgttttgacatcatttctactctgctttttcttgcaggaacctaccaatgctcttagaaaggcaagtaagctttgcattttattagttcctgattgttttctcgtcaatcttatggagttttgtaactgttcaagttccaactttgagaatttgcctgattttatattttgttggattctgttttcagacctacattgtgtacatgggaggacattctcatggtccagaccctttgcctagtgatcttgaaacagccacaaattcccatcatgatttactcgcttcttacttaggaaggtaaaacaaatgttaatttctgttaaatattattaggacgtacgtgtgttaattaaaatttgataattcatcagtcatgagaaggccaaggaagcaattatgtactcgtacaataagcacatcaatggctatgctgccctacttgaaaaggaagaagcatcacagattgcaagtgagcaaagattatgggcctgtttggataagtttctttaaaaatacttctagaagaagaaaataataacaaaaagatgagatgcgcttcttcataagtaaaaataaactctctattaattaatttgtagaagctcatcaatgtagcttctctaaaatatgagatgacatctacaaattaattaataaagagtttatttttacttatgaaaaatctcatttcatttttttctccttatttttctcttctagaagtgcttctagagaagttaacatccaaacagaccctattaccatgaccatgaccatgattttgtactcatcttgaagcctcacaaattgatataatgtattatatgtttgtatgggttcagaaaacccaaatgtagtttctgttttcttgagcaaagaacacaaattgcatacaaccaggacatgggaatttcttggactggaaaaaaatggaaatattcctgcaaactctgcttggaggaaagcaagatttggagaaaatataatcatcgctaatatcgatacaggtctgcttaatgcttacttaaaatttattagggattataaatttataattgaaatctggtaaataagaaataaatctcacataatttgatgattcagcgttatcaaataatttattttaaaatttattaaaacatattatcaatatttttcttcaatacaacaaaaaaagtaaatatatgtaaatcatttttatatttttatctaatcactaatttactatgaatattaaatttgttgatttttatataattacttaaaaaattataacgatattttttttattaattgacactgtacaataacattctatagaaattaaattaagaatagaaacgcatcttttcaattctctgtttcaatcgtcactatcatttggttttctgttattgtttaagactttcatttctctttgactatatatatgtgtatatatatgtgtgtgtgtgagtttttatttcttatgaatatatacaggtaaaaaaaattattctttataaatttaataaattttgaaaacaattttgttccatacttgctaacttttttccaaacatctctctatgaagtgaaaataattataaaatttaaattattaaagtaattgcataaatataaatttgagagactatctgtcttaattaaaatttattttaaattcattcacactaactttgagctgaaagtttgaattagtgattcattatgatatctattcgatcggactgaatcaaggacaattttgggtttttctcaacaaagttgaatatttagcttaatatctctcactaatttaattaagtagtttagatttatagtgtccccataaatttgtactacaaacatattttcctttttgtaaatacgttagttgcttctaaacaggagtttggcccgaacaccctagtttccgtgacaaaggatatgggcctgtcccttcaaagtggcgtgggaaaggtgtctgtgagatcgacacttataatggtttgtctacaaataaatgtttctgtaacaggtaaattttctttcttatttcaattcgtaaattggggttgaagttgaactaccctatagacacataataaattacgagccaggcgatattctatttactgaaatatataaccttaggtaattaaatgtaatttataaaattaatactcaagttagtgtaaagatatataaattaaaggatcagatgaggctgcatacattatcattttatacagagaaaataaaaaattatttattattctatgtgcaatcattgcacaaatgttttattttatagtttaagcttagccaaaggacagatattgaatctgtgatgctgccatagccattaataaataatcctaagggaagaacaaggacaggaccagaaccagaaccggcccgaaacttccctgttcagattgtttcttatggattcgtccatgccgattatagattgaagattcccttagggtagtttggttgctggagaagttaccatgatttttttttttttttaaatagtatggattccacaactttttttttatttaattttttttattaattttttttctctttcacataattaaacttatccttaataacacaaaaaaatacttcgataaaatatttttattatttttttaattttttattaattaaaaagtttatttaattgtttaataaatatatttttaattttttttaaatactactttattttttgaaatgttagtttataattttttttatcttgaatatatttatcaaattttctaatttctttattaaataaattatgatttattattttttatcattttatatttatcagttattcaacagttaattttactacttacttataatttaataagattaattttgaacttttagttactaacttttaatttttagtttttaattaatttttgaactagttttagtgaatataaccataataaaatttaaattttgcatatattatatttcaattaggttgagctaaggtttttaaaacggtatgattatcctttcaaaagaaaacggtgtgattatagagattcattggtgtagtcatgaaagtggttgaagagtaataattagtaaaatatttaaatatttttagttcttataatattttttcatccataaaaattaaatttagcactttctgtcgaatttcggagtcagtcgtagaggatatggcatgcagtaccatttgcagtggtattttgtccttattctaaaaaatatcatttttagaatgtagtaaatatattgttttcataattagtatactaaatccatgtaaattgtaattactgtaccaaaaaagggacctgtaattatttacattgaattatcattgaaaagagcctaacacatacggtgaaaatataattatgatgaatattcaggaagttgatcggagcaagaatttttctaaaaaatcgggaggccgaaggtgagaagattgacccaaggctgcgcagtggacgtgacttcgtagggcacggtacccacacactgtcaactgctggtggtaattttgttcgcggtgcaaatgttgaaggtaacggcaatggtactgctaagggaggctccccaaaagctcgtgttgtagcctacaaagcatgctggaataatctggacgtagaagggtgccatgaagcagacatgctacaagcatttgatcatgccatttatgatggtgttgatgtcatctcagcctctgtgggtgcgtctaatccctataaggaagctttgttaacagatgggatttccatagggtcactccatgcagtcgccaaaaacatagtggttgtttgctctgctggaaatgatggaccatcacctttaagtgtcacaaacgttgcaccctggtccttcaccgttgctgctagcaccatcgacagggaatttatcagcaacatttctctcggcaacaatcaatcctttacggtaagagatctaatctagagatttatttatttcatatttttatcatgtcaacttaatttgaccgtacttgtatcagggtgccagtcttaatcgaggtttaccaccatcatccccgtcgcaaaagttctattccgtgattaaatctgttgacgctaaacttcctaatgtgtccacggatgatgcgtaagcacagttttattttttatttcccaagcttgctcaaatatttatatatacttgtcttatacgtttcgtgtgtatatatatgtatgtatgttggtgtagccgtctttgcaaagcgggaacacttgatcctagaaaagtaaggggaaagatactaatctgccttcgaggcaataaattaacttcagctaaagaggtccaacagggtcatcttgctggcgctgtgtcagtttttgtgctaaatgataagggaagtggaaatttacttctggccgaggatcatattttaccagctgcaagtgtcggtggaaaagaaaccaatagctataaggaaattaatgacaagcctacaggcggcagtaacaagtaaagtttatatactaatcccttttaaatgtcgtatatatatacatatagttgcagcaaagcaagtgaagcacttgaatattaatttatatatatgttgttgcagggagattttagcttacttgagtgctgcagaaacacatataggagtaaagccagctccaatcatagctggattctcatccaggggtcccagttccgtgcaaccattgatcctaaaggtctataatatatacattttgttaactacacctacatgactaggtcattaacttttaattcttacaattaatgattcattagagatgaatttgtggctaaccgtaacttgtttctttttttagcctgacataacaggtcctggtgtgagcataattgctgctttttcacaagccgcgggtccgactaatcttgcaacagatagacgtcgggttcttttcaccgtgcaacagggaacttctatgtcttgtcctcatgttgctggcattgcgggtcttctcaaaacatatcaccctaattggagtccagcagctatcaaatctgctattatgactacaggtacgttcattaccaaagtaatatccatataaaatcttcatgcacaccaaatcattggcggcttattaacaactatgctttttatttatttcagctacaacactagataacaccaaccaaccgattcggaatgcatttgataagatagcaactcccttcgaatacggcgccggacacattcaacctaaccttgcaattcaccctggacttgtttatgatttaagcacaaccgattacttgaacttcctatgtgcttctggttacaacaaagctttactcaagttttttctcaatttggaatccccttacagttgtcccaagtcttacagaattgaagatttcaactatccttcaattacggtgcatcatcctggctcaaagactattaatgttactcgaacagttacaaatgttgggcctccaagcacgtatgttgtgaatactcactggccgaaggggattaaggttcttgtgcaaccaagttcgttgacttttaagaaaactggagaaaaaaagaagtttcaggttattcttcaggcaattggtgtgcctggtcacaacattcctttatttgggaatttgtcttggacagatggcaagcacagagtaactagtccaatcgtagtgctggacacttagaaattactattgttatgttataattgtcattttagtttgtttgccttttgttgttttttaggctgtaatataagcgtgttttctgttcatgttgcattgaagtgctttgtcacaaaaaataaaaggcacaatcaataatatgcagtttagaaaaaaaaaaaaatttgatccggtgtaaactattttactgggaactaaaatcatctcgaaaaaaagccccaatcttacggattatctttctttcccaccgtgggggccttgagaaggtcccccacgcttgccacggccttcaataatatgcagtttaaaagtatagttgtataatgaagaaaagagaggggtaaaaaaaagaatatatagatacggttatgtgagactaaaactccaaaaaatcagtgatatcataggtcctagagaggtaattagaactgcgggatgcggtgattaataggtaagattatattgttgtgcctgcttgtaatttggcatatttaagattattgtttccttttccttttgaaaaacagatgaaactttcattatttaactacgcaacttgttcttttccttggtttctcataaatcaaacacggagtcatgatgatacttacttgactttggagattgacttgatccaaaaatccaagtcattggtggctataattttgtaaatttaattaataggttaaagtgtaattttattcttcaagttttttaatttatgttggttttacctttttaattataatatttggtcatctaattttataaattggtaattttggttccttgttagattattaataatcaattgtgattaataaagttatgaaattaattaaaaaccattaattattaaaaacattaataaaattaagaattattaatcctaatcctttacaacattgcactcctcctcttttatacaaacatctctttcacttccattgctgcacatgacttcaagtagcaacacatttggataaataatcttttatgaaggtttttttaatgattaatagtttttatttaacttataattaacttaataactctattaattataattattagttaataatcaatcattgaaaccataatcatcaattcataaaactaggagatcaaatgttataattaaaaattaggaaaaactaaaatcatgaatttagaaaattaagagggactaaaattacaatttaactttattaataatatgttaaacaaattattgatccttgccattcatttttatgaatttggtagtctacgtaggaaaggaaaaattctttgtaaattacacatacttcccttaactattccttcattttttcaccctagaaattccgctaatttaaatatttaatggctctcataagtcataacagcagctacccctcaccctcaaacttacttaactctgttaacagaagcgcacacttgactgacacgggtttttaatgatattatgtttcaagaatgtccgtcatttgctactgatttccagcacatgaaattgaagcactgtccaaaaatgaccatttccttcttaaaccatttatttgatctggagttcatcacttaactataaacgaaaaatttagaagataaatttcaaaaacaaactaagataggcaatgaaaaacatgaataatttttttacacacacatctgcttcccaatccgcttacaatggcaagtttaatacccgccttcaaaactggaaatttcttctgtgaacttacaagaacaaacaaaactaacgtcacagtagtttctcaatgtattagattcttttatatatctcgcactccacagataagccaataacagattacaaccaaatagcaacaacaagccaataacggaactattgaagaacaataaaatttaaaaaacttcaagaacccattgaagaattaaaagaaaccctgtgaaaaacttcaagaacccggttatgaaggagtgagaaccagatctgcgaaactctgacagcggcgcagcggtgaccactcctccttcaatcacgctatcatcctccgcggcggcaactgaaagtgggggcagatccggattcttcatgctgtttaaaggatggggctgaaagtatcgttaaaaaacataaggatgtcgtgtaataagtccaaactttgggaaagttcttgtaatttatgcttgtttaatttaaacagaaactaaacgttagggagatagcctatgttccttttgtgtctgctcaaattgagatggccatagggaggtaagcattgaacatcttagactcaaaatctaaagttgttcctgtttaaagatgaccgaatactttctcttcttgttgtgtcctttccttctcgttgtatcattcttttcgggctgtaatttcttattacatggcaaagctatcctccgaaggtgagatacatctaaaaaaatactcccatactcaacttaagtctcaacatagagagaaaaatgtatgtactgagtgactggataaaataatctgttactttgagaatttaattttatatatatatatatatatatatataggccttacctcttaattaagggagcttaatatggaattatttgatagtgttaatatagtattaagataagataaactaaatttcttaattttaatggagtggttgtagagagtgtacaatcgtagttgtgaaaattgatttgaactgaccggttggattggttgaattggaaattggagcatcaatcgggtcgagttggctaatgaaccggtcatgcatgtgacccagtttggtccgaaaaaaatcgagcggttttgagaagaaccggaaatccgatcggtttttaggacccggacgggttggtgaagaaaaaaaaagcttagccacacaaaacggcgtcgtcgagatggagacgcttgttctctgtctcgacggaaatgatggcttcatcggcgttcacggctttggagatggagttggcattagatttggtgttttcgggttgcagatcttcaagcttgttttttgttttcagagggaacggggctggcagcgggtgccacaacttcttcatctgccattagctgtgatagtgaaagagaagtgtgcgctgagagggaaataaaagagtgagttcgaccgagaggaaaatatatatttttttaatcaatgctcaacaacaatgcatttttttaatcaacgctttcttcttcaatagatgcggtaagtacaaaaattcagccaaagaagaagaaatggtcttcaatggaaagcgcagcagtcgcaaccaacattcaacaaggaagaaaagaaagtatatatagtggataggtttttaaattccttatctagcggggtttctttggacctaatttactttatgtattcattttttttgctttattcagttttcatataactttttgaaatgagtttttgtgtttttatataggtagttgttatttacagtcttttttatttttaatatactttacttgtattattaactttaatacttcaattgttattttggattttccattatagaattatggatgaatttttcttaatcaaataatattagttatatacgtatatataatataattttgaattttttaatatagaccggaccaaatctggtcaattattgatccaccggttgaaccactgacttagtgacccactatcttgaccggaccagttttcacaacatgtacaatacttttctttaatagagtggttgtcgagaggatgttagactatactaatttaataagaactaaaagcaaataatctatatattacaaagaaaaataaaagaaaataaatatattataagaattaaaataaaataaaaaataataaaactaattttttctacaagaaacattttaaaaaataattttataaggaaataaatatgttataggaattaaaatatatttgaaacatttttcatttaaatggttttttctatctctactcctatttttaaaaattcaaaatttcactttttttaataaaataaaaatattgaactagttttaagcataatttaataaacactcaaaaaaatatcgaccgtacgtaagtccgtaagtgcgcttttgttcaatttgtttgtacgcgttctttcagtctttcacatattgaccatgagcagcatttctgctatttcattataactactacatccatcctataattttttgagaatttctttttcgataagatctcttttacattgttttttatattaattactttttactaaaatactcttgattattttgcatatatttaattgtacactgtaacactaaattataattatttcatgaatttacaatttgaatattttccgcagattttatcataacaataatttttaattttgctcattttacggatctattgttaaatgtgtaatgacattttgacatgtctttagaaacaatttaaattataacgttgtttggtagaatttaaaatttattaaaaatcataaaattttgagtcttacgttatatataggaaggaacgtggtagctttgagcgtccaacatcttgtactttcccataatcacccaatagctcaaacatggttttcactaagctttcattaattcgactgattttctgttcactcctaaatctccattcctcccaagttttcacgttttcatcttttgcctttgctgccatcactgcttatgaagggacggaagcaaatgctctagttgagtggaaagctagccttgacaaccaaagccaagcttctctgtcttcatggacaagtggtgtcagtccttgcaggtggaaaggaatcgtttgtgacgaatccatctctgtgaccgctataaatgttacaaatcttgggctaaaaggtactcttcacactcttaacttctcatcctttcccaagctgctaactctggatattagttacaacagttttactggaactattcctcagcaaattgctaacttgtccagactttctcaattgataacgaatgctaataattttagtggctcaatccccatttccatgatgaagttggctaacttgtcaattctaaacttggaatacaataaactttcgggctctattcctgaggagattggagaattgcagaacttgaagcgtctaatacttcaagggaatcgactttctggtaccattcctccaacaattggaaggttgtccaaccttgttagacttgaattgtcaaaaaactctatctctggtacaatccccacttcaattacaaacttgacaaatttagaactccttcagctcacactcaatagtctttctggctccattccatcctccataggagacttggtcaatttgattgtttttgaaatcgataaaaataaaatttcaggattaattccttccagtattggaaacttgacaaagctggtcagtatgtccattggcgttaacatgatttctggatcaattcctacctccatcggaaacttggtcaatctaatgagcatataccttgcttttaacaatatttccggagttattccttccacctttggaaatttgacaaagctcacccatttactagttcataaaaacaaacttaatggtagattaccacccgcaatgaataacttcaccaatttcatatcgttacaactatctaataacggtttgaccggccctttgccgcaacaaatttgccttggtggttcacttgaacaatttgctgctaactctaattatttcacgggtccagttccaaaaagcctgaaaaattgctccagtcttgctagactcagactagatggaaaccagatgaccggaaatatatcagatgtttttggtgtatatccagagttggactacgttgatctgagtagcaataattttcatggccacatttcaccaaactgggcaaagtgtcctaatctcacaagccttatgatgtccaacaacaatttatctggtggtatacccctagaacttggccaggcgcccaagttacagagacttttcttgtcttcaaatcatctaacaggaaaaattccaaaagaacttggaaaattgacctctttgttggagctatcaataggcgacaatgaacttttgggtaacattcctacagaaataggttctttgtcccgccttgaaaaattggagcttgcagcaaataatttaggtggcccaattccaaaacaggtgggatctttacttaaattacttcacttgaacttgagcaacaacaaattcacagaaagcattccttgggaatttaacgaattgcaatctcttcaagatcttgatcttagttggaatttgctaaatggagaaataccagcagcacttgcgagtatgcaaagattggaaaagctaaacctctcgcacaacaatctctctggagccattcctgattttaagaatagcttggcaaatgttgacatatctaacaaccaattggagggttcaattcctaacattccagcctttcttaatgcttcatttgatgcattgaaaaataataaaggcttgtgtggaaatgcctccagtttggtgccttgcaacaccccaactcatgataaaatgaaaagaaatgtcatcatgttggcattactcctttctttctgcgctttatttctattattattggtggttggaatttcgttatgtatttgctaccgaagagcaacaaaggccaaaaaggaggaggataaagaagaaaaaagtgaggatcattattccatatggagttatgatggaaaattagtgtatgaagatatcatggaagccacagaggggtttgatgacaaatatctcattggagaaggtaggtctgcatctgtttataaggcaatattacccacagaacatgttgttgctgtgaaaaaacttcatgcttcaaccaacgaggaaacacccggtttaagagcttttacaactgaggttaaagccttggcagagatcaagcatcgtaacattgtgaagtcacttggatattgtttacatccacgcttctcctttttggtttacgagttcctagaggggggtagcttggataaagtactaaacaatgatacacgtgcaacaatatttgattgggaaaggagggtgaaggttgttaaaggtttggcaagtgctttgtaccatatgcatcacggttgctttcctcctattgttcatcgtgacatatcaagcaagaatgttcttatagatttggattatgaagcccacatttgtgactttggaacagctaaaattctgaatcctgattcacaaaatttaaccgcatttgcaggcacctatggatatgctgcaccaggttaggccctttttgtttttaagaagttaatcctatatatacttgtttcaataataagtcatgctacttcttgtgtaatatcattttcatattttgatatattacagagcttgcttatactatggaagtgaatgagaaatgtgatgtttttagttttggagtgctttgtttggaaataatgatgggaaaacatccaggaaatctgatttcttcattattatcaccctctgcaatgtcatcagtgtccaatttcctgttaaaggatgtgttggaccaacgactacctgatccagtgaagccagttgttaaggaggtgatcttgattgcaaatataacattagcttgcttacgtgaaagtccacattttcgcccaagcatggaacaagtgtataacgagtttgtgatgccaacatcatcttcagtgaatttattctccatgatcacacttggtcaactcagagataattgaaccttgttttatggtgtattaattgtaagctttttgttatattaatgtttgttgtgtgcgtgttttacatgtttcttctattttgtcagacctggaaaatattgcaaagctgtcttatgtctttaagtaagaccccgagtctttattttgtaggttgaataaatacggtctagttttaaagggagacagtagtgatgtcttttaagtaattaaggatgttttgactatatatttcaacattaacgtaccacttgaactctcttccaattcatgatacatagtctaaataccatttaggactatggccaatttgcaatatgatttttattaaaatctattgttcaaaatatccttatgcgaattttcttgcagattaaccatagatctaagtgatattcaaaatacagttgctacaaaggaagcagtttgggattttagcgctagtcttcactcttcagtacggcgtctaatttcattttttttttattttttaatcaaatctaactagtttgggattttagtgattgactttattttttattttttaaaaataaatccttcaaaaatctgaaattaaaataagctaaatcaaatgcattacttcaatatatgcttccttgattccgatcaggtagagcactcttgcacgcggccccaatttgaacgtaattaattgtagtgccagctgttggattaattgaaaatatatactatgattgttatctcaaactcactcaaaaaattgaaccaagttgccaacattggaccagaagcgaggaggaaaaacaaaaaaaatctggacctctcgactttgaaaatccaagaaaaccttatctacccttatcctaaacaagatcgcatgttggtatcttgattggaagaacttgtattgaatggcaaagtatatgataatttcgtttctattatatattatgtatcatgtttgatttgtggaccttacaactacacaagtcttttcacaccacgtggtgggaatgttaatttgatttgtaaatataccaacctaaattagacaagacacaagagtatcataaaacaagcatataagtggaacaactaccacttccctacttggcccattaacaacatcattatgaacctcaaaatcacattattatagtttgagtaaattatattcacatttcatatgttttttttttaaaattgtattcgatactcttttcttattatatattacttttatcctattctgttaacattgttaattaatgtcaattgaaatatttgaatagacaaatttttttattaaagtaaattatactcgcacttcggtatttttttttcaaattgtaggtactcctcattttttatacattattgatctcgacggaggcgttaaggctgttaatgttattggccctgacgacgtcagtgtttagggaaccagacacaatgatgatggtggtcgaagatacaacaggggacgagaaggtgatggaggtggatatgacggtggtggtagcgattacggtggacgtggttgctccgacgagagtggatggggacgacaataaggaggaagaaataatgttgctgtgggagagggaggaagaggagaaggaggtggtggtggtaagtaaagaaggattgttgaagaagaggaggatttgtaaaactcaatatttgattttaaggaagaagataaagatattttagatataaattttcatcaaaagttatgtgaccagcatatgcttattttcttttaaattattaaattgtgtttaggaaggagaaagtctggctgtaatataagctaaacaattaaaagaattttttgtagggtgcaaaaaaggagaaatatgcgagtgtaatttactcttatagttttcacactatttaaattgatggaccgggttaaagtcttgggcaatttcaatgtagataactgatttgtggccatcctagtgatgccgcctgcagctaaggttttaacttgtggtcatgattagcgttgcgttttcattataatcgttttcattgtaatctttgtaatgtgcaaaattgcagataatacacaattaatgcagcctcagttaatgtaatggtagagatctcaatttttttgacgttgcagataaataaaatctttttaaaaccttggatgcagcaagaagtacatatatggtcaaagaaagtgggactaatatgccatacatgtatttaatacttaatactttgtttctttaagcattcttgagggaggaagaaactagccaagttctaaaatgagaaattaagctgtagtaacaaacaaacaaaagatataatgttgtgataccctgacgacaaattattagcacagtgcaaaagattgaagaagctggcgcaccatgtatattgcagtccacactccatgttatatagagtgctaaaagctaggctactctaaaactacataaaactactattaaaacggaagagaagataaaagataacattgatatttttcattcatgatgataggtaaaggaaaatacatttagatagtactaaatgatattaatccatatgtggttctggtgaaagagaatcaatttagtgacatttcacacttcaactactatactttttctgtggtgaatgtgcatttattattattattattcatgtgttttggaacgttctgaaaatttataggctttgaacaaatgttttactgtttggttgttcttttgcatctcttcccttttaaggaatgagaagggactaattttcaggtgtttcgtgtgcaattttgaggcaagaatcgtggtattattaatcaagaatttactgaggtgtaaattcttcctaatttgatgtttggggtgttggaaatggaatgacaaagataaaataagagcttacactaaattaaaatttcactcaagaacaaaatattacaacaacaaaatacaagtgttataacactaactcaaactttgtatttctctcaaatctctctttcttttctcacataagtgtttcaacactatttctcactttttacacacttttctcttcacttccttactttcactacatgcatcattttcgagtgttctatttgattgtccacgtccatcacgtccgccacgaccacctcgagtgttgaatctacctcgagtgttgaaacatcctctatatccaccacgatttcctctgccacgtccaaagctactgctagctcgattttcatcaaatgataacttactttgcaaagcttgctccaaactgctagagccttcattcagattcattctttgctcatgagcttgaagggaacccacaagctcatcaataggcatcgccgtcaaatctttagcttcttcaatggcagtgacaatataatcaaactttcttgttagtgatcgaagaaccttctccatgattctgacttcatctaaggcttctccgtttcttttcatctccttggtcaccttttgcactcgagagacatagtctgtgacttgttctccattttgcatcttcaagttttcaaactcagctctaagtgattggagccgcacctttttggctttatcagctccttggcaggatttctgcaagattttccatgcttctttggatgactttgcgtctgatattttttcaaaggttgtttcatcaactccttgaaatataaaaaatagagccttcttatccttctttcgtaactctttaagtgtccttctctgagcatctgataaaccagcttcagcagcggcatcagcgggctctatgtatccatcttcaataaggtctcatgcatcttgggaacctaatagagccttcatctgaatgctccaatttccataatttgtttttgacaactttggaatttgtggttgcatcatctctgccattttgatcgaacgtggctctgataccacttgttggaaatggaatgacaaagataaaataagagtcatacaatcgtggacgaggtcgaggatttatgaccagaggaggaggcagatttcaaaaaagaggtgacaaatctcatatgcaatgttataattgcaacagatttggccatcttagttacgaatgcagagaatcccctaaatttgaggagagaagtcattatacaacaaatgaagagaaagctgatgaactgaccatgttgttcacttacaaagacaaggaagatagtagcaaagatgtttggtacctcgatactggagctagcaaccatatgagcggaaacaaagagttattcacagagttgaacgagaacgttcaaggagaagttacttttggagatctatcaaaagttccagtcaaaggcaaagggaagatcatgatttttacaaagaacggagatagaaaatatatttatgatgttttctatatcccatctttgaaaagcaatctcctcagtcttggtcaacttttggagaaaggatataatatacatttggagaataatacacttatcatcagaaatcaaaaaggagaattgattgcaaaagttgatatgacaagaaatcgcctattcaagctcaaaatccagacagaagcaataagatgcatgaagtctgacataaaagatagttcgtggttgtggcatctcagatttggtcatcttggatttactggtctgaagctattgtcaaaagcaaagatggtgaatggattaccagaaatcaatcatccagatcagttatgtgaaagttgtatgaagggaaagcaacatagacaaagttttgaagtaggcaagacatggagagctagaagaccgttgcagctagttcattcggacatagctggtccgtttgatatttcatcccttggaggaaacaggtactatatcacatttattgatgatttcagcagaaaaacttgggtgtatatcatcaaagaaaaatcacaagcccttgataaattcaaggaatttaaagcaatggcagaaaagcaaagtggtcaatatctgaagatactcagaatagatagaggtggtgaatatacgtcaaaattgtttgaagaattttgcagacaacatggaataatacatcagttgacagctgcctatagcccacaacaaaatgggattgcagaaagaaagaatcgtacaattcttgatatggcgagaagcatgcttaaggaaaagtacttgccaagaacactttgggctgaagctgttagttgtgctacttacttattgaatcgatgtccaacaaaaagtgtaagctcttattttatctttgtcattccatttccaacatggggcaccagacgtaagctgtttttttccctatcaattttgaaattcctcatattttgcctaccagttgttttgtttactcgttttcctaattatggcagaaagtcaatcatagcttttaagttcttatttatttacatgttaatattgttgaaacaaataattttggagaataatgtgtttaaactccatgaactactgttctttcacctttgcatttatatagttagttttgttgtatttaaacaggttggtcaagatgacatgcatcacggtatactctattgatatgattccctaaagttataacttttgtcgcataacagggaaatccttcaatctaaattttattaatggattgcaagagttctttagtgaggaattgtcatcattcatcaagtattgaccaagaagataccgagatatccaagattttttttttgagtttagtgaactttgcaatgactcttatgataaattatcgtgcagttgagatgtcaaacagatcaaaattaagtggtgtttgctgaaataatgtcttttttatataaaatgaaagaaatttacattggttttggcttgatcctcaaaatttccaacacttctttgtatacgtatgcttaagaataaagaaaaaagattagtataagacagcagtactttttatggactataataaagttatttacaagcaataataaaggacagtgaatgagtacaattggaatttggaaagctacttttagttattagtattgccagtaaacatacataggtttcaccaaaacggtaatggcctttaccagcattcattataatggcggtaaacccttttccgactctggaaaaggtgacatagtctaatagccggtaacactttttgagggaatttatattgccggtaaatggtatataacaattgccggtaaaagttatttttgttcacattgtgaagttaaaagggttctgttcacacttcacatccatgcttttcgtttctggtctgagttccttgaatgggggagtttggacaaattacaaaaggatgatgcaaaagcaataatgtttgattggaataggaggctgaatgtagtttaaggtgtggaaagtgctctataccatatgcatcacggttgctctcctcctatactaaaacgtgacatttcaagcaagaatgttcttatagacttggaatatgaagctcgcttctctgactttggaactgctaaaattctgaatactgattcacgcaatttaaactcctttgtagttgtaggcacctataggtatgctgcaccaggtttggcacttcatgttgctcttaagacatcaatcttatataccatatactcttgtttcagttactatatgagtaattttattttcatattttaatttatggtagagcttgtttatactgtggaagtgaatgagaaacatgattgttgctcttttgttttggtgtcctttctttggaaataatcatgggaaagcatcctgttgatctcatttcttcattgttttcattgtcaacaacaccatcagcatctaatttgttattgaaggatgtgttgtaccacaataaatgttaagaaaaattgggttacaaggtactcttctcaatctcaacttatcatcctttcttaacttgctcaatctggatgtgagtttcaagtccttgcattggcatattccccacaatattggtcagttgtccagagtttctcaattgaaaatggataacagtaattttaatggttccatccctctagaaatagggggaactgagaggtcaaagtcaccttgacatctccaaatgtaagctaaacgggtcaattccagtttccatagtaaagcatgccaacttattatatctagatttagctggcaacaaacacttgatttgtcaactaataatttctccggagccagcccttcacttaggaacttgagaaacttaatgcaacctttcctatttaacaaccatctctctggccccattcctgaggagttgggaaaacattattctctcaaagcaatcaaattgttgaacaataatttgtcttgcccaatcccatcttccataggggatttggccaatttgagcacacttatgctcagtggtaataaacttgggggatcaattgcttccactctttggaaatttgacaaaacacactgaattggtcctaaagcaacctaaagcaaaaccatctttctgggtaaatccctgtttccataggaaacttggtcaattttcagaggcttcgcctctcagaaaaccaactttctggaactattccgtccacctttggaaatttgacaaagctcacccatctagtgctcatcacaggtccagttccaacaagcttgaagaattgttccacccttgtcaaactcatacttggagacaaccatttgacaggaaatatatccgacgagtttggtgtatatccacatttgaacaacattgatctgacaaggaataatgtttatggtcacatttcaccaaattggaccaattgccatagtctaacaagcgttaaaatgtctagcaacaacttatccggtggtaaaccaccggagctcggccaggcacccaaattataacaagttcaactttcttcaaataatataagtggaaaaagtccaaaacaaattggcatattgaccctgttgtttgaactctctttgagtcacaatgaattttctgactacattcccacagaaatgggatctttgctaaaccttcaatgtttgaagcttgcagcaaatagtctaactggtccaattccaaatcaacttggacgacagcgcaagttaattgacttgaatttggcgataataaattatcacatggccttccgtctggatttaactaattgcagtctcttcaaactcttgatcttagtggaaacttgttaaatggacaaataccatatcacttggaaagtagcacagattggaaaatttgaatctctcgcacaataatctctggcaccattccatccaattttaggaatttgttgagttagacaaatgttgacatatctaacaactaattagaggttccaattcctgatattccagcctttcttaaagcctcatttgaagcattggaaaacaataaagactcatgtagtaatatctcgggcttgacaccttgccaaaagttgagtcacaaccatcacagtaaaaggaaaaatgtcatgatgttggcgatttccttgacctcgggtgctttatttctagttgtggtcctggttggaggttcattatgtattcatcaccagggagcaagaaaatcagaaaaacaggttatagaagaacaaactcaagattatttttccatattgggttatgatgaaaaaacagtgtatcaaaatatcaatgaatccacaaaggtgtttgatgataattatctcattggaggaggaggttctggagctgtttacaaggatattttatcatctggccatgtcgttcctgtgaaaaaatttcatgctgcagtggatagggaaatgctcaatttaaaatcttttacaagcgaagttcaagccttaacaaatcaaacatcataacattgtgaagttaaaagggttttgttcagatccacgcttctcgtttctggtctctgagttacttgaagggggaagctgggataaagtactaaaggatgatgcaaaagcaataatgattgactggaatagcagggtaaatgtagttaaaggtgtgtaaagtcctctatagcatatgtaacataattgctctcctcctatacttcatcgtggcatatcaagcaggaatgttcttatagacttggattacgaagctcgcatctctgactttggaactgctaaaattctgaatactgattcatgcaatttaacctcctttgtaggcaccaatgagcatgtcacttcatttttccctgaggttttgtttgggagaggaattttagaggggaaggaagggatgggaaagatttaggtagtgacatctctttatttgagagttttaatttttgaggaaaaggattttaaaatccctctaaaatctttcaaagtctaaaaattgttgtcccctaatttaaagatttttagaaggaaaagtaattaaaattattatcctaccccagctacacgttcaaaaatatattaaaatatatttttaatatatttttacatttaagttatataattttttacatttaatatcttattaatttttcatttttctctcttaatatatttttaactctcaaataaggagaaagaatttctctcattttcctctcattccttccccttccttcctcttgaatctctttccttcccttcctctcataactcccaaacaaagcctaaaaaaattaatcttacacactcttgtttctacttctaatacgagcaattttattttcatattttaatttaatgtagagcttgcttatactatggaagtgaatgagaaatgtgatgtcttcagttttggagtcctttctttgaaaataatcgtgggaaagcatcctggtgatctcatctcttcattgttttcattgtcaacaacgccatcagcatttaatttgttattgaagaatgtgttggacccacaacttacgcttccaatgaagccaatagctccgtggttgatcatagttgcaaaagtaatatttgcttgcttgattgaaagtccacagtctcgtcctaccatgaaacgtgtgtcaggtgtttgtgaattgtgatgctaaaatcacctttaatgggtccatttcctgttatcacaattggataactctaaaataattggacttggatttattttgcattgtaagcattcttgtctttctgctttgtaagaaatcatgtaataccgcatagttataggattattattgtaacaattgtactaggcatgggtttaagagcataacaatagaaaccaattattcctattatattttacatgtttaatgcattaacttaataatttttgtaagaaaataacccaattgtttacactttcatgtgattcatgttttgacatctttagttgaaaaatagtatgattgcacttacgtatttgtgtttttaaacgtaaaaaacgtgcaaggaaacagaagatgtccaagacttagaaagaagagcaagacaaactcacaaagaaagtcaagtctaacttggggactcctgtaatgtaactgggatgatcttgatgtttgaagaaactttaaacatagatttatactttttatggagcttagttttttcttttggttgattcatggagagactctaatcagatttaacacggatcatacatgaaatggggcttaaagttgaagttgatgccctatcagagagcttgtcataggatataaattaattgaattgattttgtttttcctcaaagaatcttaaaaagtaatttaagtaaagtcataattagtttaagtaaatcttaattattatttttttcttatagacttagaaataattaacaataaatttacttctagcatatatttctcagtaggtaggtgacgtacatttcgtacaccaatcattaattcttcacattaaaatcgtcaatcctgaaaacggtgaaagcagagttttgttttttaaattaaagatgctcaaatattattgatgaaatagagaaaatagaccattgctcatgatttggttcaatttagggttgttcgcgggtcggttcggatcaattttgattaaatttaggatctaattcaatcaaatttgatcggctcggttggattcgatttttagaagaagaaaaaatagaaatccaacccaatccaactcattcatcaacggttcggtttggttcggatcattgggttacccatttaattttttttagaactactattttatatcacgattctttcaaatatcccatacaattaacacaatattattaaatgtatgaaagtagtaaaattgattcatttaatactgttaaaaatcacatatgcataaattggaataataattcatgattcgtttcatttattcatctgttctctctcatctatctttcctcaacatgaggttcttatataagagagaaattcaacaaaatgctaataatacgagaaaataacaaactgatctaatcttaattcctattcaaatattaaaatataataacaaactgtaacaacataataaatcataacaataatttgaaatttaaattatacaattcaacactccccctcaagttggtgcatgaatatcggtcatgcccaacttgccaattgcttcttcaaacactcttccaggaatgactttgatcagcaataggttcaagaggtgcttcatgatagtccacgtgcttcggttatgtgaggtagaaagaaaattgaaatacgagaagagattcggaacaataacatgttcatgtcaataaacttcagggatggtctatgaagattcagaacaatgcaactgacttcacatcaatgaccttcaaatagaatacgtgcaaggagaattgagatacgagaatggattcggaacaatcacatgttcatgtcaatagacttcgagtttggtctgtgaacaactcaaaacaacggaacgagtttcacattaatgacattcaaatggatacgagaaggatacgaggcaaaaatgaaatttatgataataataatcataatttgtaaaggaatcgaagaaggtgaaggttaaggaggagatagatgattaggtataagtgaaatatattgaagataagataaaaagatagaaggagatatacgtttgggaatgtgaagaagaaggactttgaaaaaataaggcagcagaaatattatttttttcatggaggattcatggaggataccatgattctcattcatggaagaatcatggctctgataccataaattggaataataattcatgattcgtttcattcattcagctgttctctctcatctatcttccctcaacatgaggttcttatataagagagagaaattcaacaaaatactaataatacaggataataacaaactgatctaatcttaattcctattcaaatattgaaatataataacaaactgtaacaacataataaatcctaacaataatttgaaatttaaattatacaattcaacaaataccatcaacataatattctaaaatagacttataatataaattaaaacaaaagatttttgaacaaaatttactataatagtctgaatcacaattgtttcttacaaatcaagctttgttataaccaatttttttacaaccatatttactgaaacaaataaataaacaaaatatgattcattaatattataaacatgataaacaaaatatgaaaaaaaatcataaccttaaatcaattcttatttcaaagcaacatattgttagtacattggttcttctgatcaaattttccattattttgttttcagctacttaaagttttaaagtagggaacataactcaaatgtctaaaatacaaggtcctaaataattagttgagtgctatgatttatttatataaactgtggatgaccaatttaagtcaattgagaacttttttaattataaaaatttgctattaaaactttaacatatgaatattgtgttggtcccagatgaactcaagagggggtgaattgagttttataaaataattaataattaaaaatcaaactcaaagcaataatatggaaataagagataaagaagacacaatcaattttaacgtgaaaacccaattaggtaaaaaatcacgatgtccaaattggataatcaattcaatggacaactcaactatgataattttgtatacaagagtttctaatatcctagtttcctagtctacctacctttacacaacaattatcccacctggtatccttgtttcccagcaaaaaaactctagtttcaattcaccaagaatagagaaagactggtatcattgtttcccaaccagactggtatcctagttttccagccagaagtcgtacgtctcaattcatcaagaacagagacaaaattgatatcatagttttcctgctgcgaccttttccaaagtcaagaagaataatacaataaaatagttaccaacacttctactccttaagcaaataggtacctttaaatcctgatggagagttgaagaatcggacttgacaaacgcttctatatgatgtcacagcaaaatatctcaatgatacaaacttaaactttctaaaactctaatattatttggaatggaatgcatacatgaacaccaaaatatgtttctatttatactaatttaaagatagattttaaccaatttttgaatcttatccaatgcaattttaaagatattttattatattatgcaatgcaatcttaaaaatattctatcctattttttaatgcaatattaaaaaatattttatcctatttttgaatgcaatcttaaacatttacaatatcacaccttttttttattgtcaaattattttttttaatttttaatatatatatataataaaatttaaattattattacgggttcacggatcgggtcatcgggtcaacggatctgtaaatctaaatccgtaattcaacctgaatatgaacgattttgatcgattcgatttgatttttatccaaatatataaataactcaacccaaattattcggatcggttcggatcattcaggttaacggatgatagatacctgtgaacacctctagtccaaatgaaatgggacctcctcctgaatccaacatccatttaataaataaaaagacaagaaagctaaacaagggacagctcgccttgtcttttttgtgaatagcaattcttaccttgaagcataagaactaattcttctcggcaaaagaacccaaataatacatttttaataaaaaaattatgaatttggggctgtttttaaactaattaccaacttggggcaataggtcacgcccaaaattgggcgtgccagtcacgcctggtgttgggcgtgactaaattcgtcactaaatccgtcgctaaatctgttagcgaccgatttagcgacggaatatttgttttttaatttttttgtttgcgagcaaaatattccgtcgtaaaaactgttagcgactaaaataaaaatcaaaattggcgttttttaatttttgacgtaaaatatcatttaatattatttatttttatttaatttgaaagtatttttagactgatcttcatcatagatatgatcttttttacttttttttaatattgttttatttagtatttttttaaattttatatgattttatttaatatattctggatttttgtatatataatttttaatatattattttgtttaatataatttataaatttttatatgattttgtttaatattttttggattttgtatatataactaatttttaatataatattttatttaataattttattttggaatttgaaaaaattgaaaatttttattttttgatacttctcattttttctaaatttttgtaaataaatttttaatatagaaagcattttaaatagaatattatattttgatacttctcattttttatatcgaaactaccccatggtgaatgatcaattctttgcatttcaatttgatttactttgtctctcacagtttcactcctatttctagagttctgcaatgtttcaccgctccaagtgcgctttggaattaatggggtgctacaattccgattattgtgtggtgagtgcactttgggatgagcggaacgagtggtaaagtgtggaatgagtgcgaaaaagttaggaatgaatgtgctttgggataaatggggttattatacaaaaaatccaaaaatattaaacaaaaccatataaaaatttagaatatcgaaaaaagttacaacggtgtacgatatgtccttcaaatggtctaacttttgataaaaatatccgatcgaggtgtacgatatgtcgaaatgctcgaaattaatagaagtaattaaaaaataaaaaatagcatacaattaactgactaaataattaaaaaagtagaaaataataaaatttttagatgaaatcataattttgaggcacttagaggtcttttttgggaaaaaattttgtccaagtcccctttggttacttgccagaggcttctcctctcaatttcgagcgcatgaccaccgatttcgtcttaatcggacattccagtcaaaaattatgaccgtccgaaatttatatacgcatcgctccatctgtgcatgacaggtatcaggagtaggtcacgtctagaactggtcgtaactggtcacgcccaacaccagacgtaactgccccctagtcacgcctagtgctgggcgtgactggtctggagtgaccaactgtcctaaattggtaaatagttttgaaacagcctcaaatatataattttttatttaaattgtattatttgagttgttttgctaattcttctcacatcctctgccagactatgaaataggcttcttcttatacctaatattaaaaaaaagaagaaaaagaaatatgtttcttccacgcctgacaaagctgaaaacaattcatttcatatcgagctcctattatgcataactctgccactttaatttttgcccatataaatgcaaaacgcattatctccctcgggcacaattcttactctgttatgataaatgttgaatcattgctttcttgttttggtgtacggtgaagagaaaagaataataaaaataatggatgtaataaatgttataatgaaaaataaagggagaaagataaggacaaaaaaaaccatagaatagaattaggataaaaaatgaggaaaaagttaaaataatactattttttaaaaaattacaaatttaaacttgttttgaaactatttataaatatgagactatcaaacacgtttaaattagatgtgactaaatacgtctaattttgaacgtgacacatgaagtaatacgttcaaattagacgtattcaattatgcacaatttgaatatgtttgacaaccttgtgtttatataattttaaaatagttttaaatttgtaattttttttaaaataatattattttaaattttttccccaaaaaagaaaagaataaaagaataaaaacaaagtaaatatatgttacccattttccaatataagcagaggcacagtctggactaagccagcccagaacagaacaacagttgaagatacatgatgtcattctccatcttcaaacttgttttgacatcatttcttctctgctttttcttgcaggagcctaccaatgctcttagaaaggcaagtaagctttgcattttattagttccctgattgttttctcgtcaatcttatggagttttgtaactgttcaagttccaactttgagaatttccctgattttatattttgttggattctgtgtttccagacctacattgtgtacatgggaggacattctcatggtccagaccctttgcctagtgatcttgaaacagccacaaattcccatcatgatttactcgcttcttacttaggaaggtaaaacaaatgttaatttctgttaaatattattaggacgtacgtgttaattaaaaattgataatttaacagtcatgagaaggccaaggaagcaatgatgtactcgtacaataagcacatcaatggctttgctgccctacttgaagaggaagaagcatcacagattgcaagtgagcaaagactattactattaccattaccatgaccatgattttgtactcatcttgaagcctcacaaattgatataatgtaatatatgtttgtattggttcagaaaacccaaatgtagtttctgttttcttgagcaaagaacacaaattgcatacaaccaggtcatgggaatttcttggactggaaaaaaatggaagaattcctgcaaactctgcttggaggaaagcaagatttggagaaaatataatcatcgctaatatcgatacaggtatgcatattgcttagttttttttttcttttttagtagatgcataatgctttagttaaaattaacatttattagagattatgaaattataaatgttttttatattgttattcaattataaggtattatgtatgctaagtttttttgttggtacaatatgaaaaatgtatgataagtttgttattttttataaaaaaaagatactttaaaagttattcaaacaataatttttaattaattagatgtatactataattatgcataaaatttaaactaaaaacgaaacgtattcctttaaagcgtcactgtcattttgttttctcttctctttgactagctgttattatttttttgcttatatgtatttatttattaaaatatagataaatttatttttagtctttataaatttttaaaataatggaaattattactttatcgtgatatgctatatttagttacatcattttgatagttattctaaagtaacatgtgatatgacttgttgaaatatatatatatatatatatatatatatatatataaaattaaacaatagtattttaaaaaaagtttacaaagaataaattaataaaataattactcataacagataaaaattctatttaactatatttatagaaattcaaaaatattttatcctattttttagaaaatgctaagaaaagaaaaacaagtatttgaggattttatataaaaaatcattaatttgtactccaaagtccaaacatgtattcctcttgcaatatattagtagtagctttttgaacaggagtttggcccgaacactcgagtttccgagacaaaggatacggacctgtcccatcaaagtggcgtggaaacggtgtctgtgaaattgacagttttaatggcaccaaggagtacttctgtaacaggtcaattttctttcttctttcaactttcaattcgtaaattggggttacccataaacacataagaaacgagccttttaaacaaaggtaatattctttttactgaaatatataacttaaggtaattaaatgtgaatttataaaattaatactcaagttagtgtagaaaaacaaaaccaaaacgatcaaatcaggctgcacgtacgttatcattttatacagagaaattaacaattattgaatgtgcagtcatagcgcaaatatttttattttatatatttttttcaatataagtttagcaaagggagggactgtgataccaggtatgaagccataaatttgtcacttcggaaacaaaggatattcaacaaacagaaaaggacgggacttgaacctgacccatccctcttcagatttttcttttgtaattagtttttggattcgtcctgatatattcttggaaatatttttagcagaattcaaaattttgcatacattactttgattttatttgtttcacggagtaaaaatatattcttggaaatattaacatggtaactgatttagaccattttatttatctgtctttctattctcatgcaaatgtgagaagctttattttctaaaataatttttcacttttctcttattctattttatttgttcaacatttttattttaaattaatataaatttaaaaatattccaagtaatgttaaatatttatcgaacatcttaatatttcttgtaatagtatttctaagaatattatttctgctgtaaaaaaaaggaatattattcctggaaacaaacgggattttcttttgtaaattgagttgaggtaatgtaatgtatatgagggtgtccatgtatatttttcaaaaattaaagaggttggtgtaggataagatcgataaaagtatgatatgatggatttgtgtaatttcaaaaaactttagaaatagttatcttaatttactttaaatcatattatccatccaaagatagaggagaaataagatgctagaattatgataagttgttaacgtgatatttactggatatgctaaatttatacgcttgtaaataaaagatgtaaatatcatgtaacatttgttttattgaagaatagtgatatttggacatcaataatttattaataagtcatttggacactaataacttacaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttacaaagactcatattttttttttcttaattcttagctttgattcatcatgaaaaatggatgttgtttaatacagagttcgatcgaaaaataaataaaatcttataaaaaattatttttgtcaacgattgaactcagtactactcaaatgattcaactttaacttcaatatattaattattaattattaatactcaatttcttgattttacaaatactcaaatgcatttttttgtcacatcatatcatcaatcttatccattattaatctctccctttctatctctcttaagatgtctatatcctttaggtgtccaataatcatttctctttaacaaaatcgggtaggaatatcttatatataggcctttgtttaggagcatatttgatatggatatttatatagggtaatttaggcgtaactttttctttgccacaaacatatgcatatgtttaggacttgggagcaacatcgcaagcttcatgatgaatattggccagtgtatatatctgcactgattgatcctttgaatgacagaacaaattcgataccttttaggtatctaacataaattgtgttggcaagctaataagaatacctgttgtctagaaaaaaaaaaaaaagctaataataattttttaaaaaactaatttgttttcataattagtatgttagatacctgtattgatttagttcagtttatcattggaaattttgttgtaagtaacaaggtagaaaggcctataatattatgaatatatatattcaggaagctgattggagcaagaactttcctcaaaaatcacgagtctgaagttgggaaggttggtcgaacgctacgcagcggacgtgacttcgtagggcatggcacccacacactgtcaacagctggtggtaattttgctcgtggtgcaaatgttgaaggtaacggcaatggtactgctaagggaggctccccaagagcacgcgttgtggcctacaaagcgtgctggcataaactggacacaggagggtgccatgaagcagatattctacaagcatttgattatgccatgtatgatggtgttgatgtcatctctgcctctctcggttcgtctaatccttataccgaagctttgttaacagatgggatatccataggggcattccatgcagttgccagaaacatagtcgttgtttgctctgctgggaatgatggaccatcacctttaagtgtcacaaatgttgcaccctggtccttcaccgttgctgctagcacaatagacagggattttctcagcgacatttctctcagcaacaatcaatccattacagtatcatctttttatacttttccttaatttattagtttcatatgtttttattatgtcaacttaattaattggaatatgtgtgtatgtatcagggtgccagtcttaatcgaggcttgccaccatcgtcaccgtcgaacaagttctatcccataattaattctgttgcggctagacttcctcatgtgtctattaatgatgcgtaaggacaatttttgtttttatttcccaagcttgcttcaaatatttatatgtacttgtctcataggtgtatatgtatgtatatatgtatgtttgttggtgtagtcgtctttgcaaaccgggaacacttgatcctagaaaagtaaggggaaagatactagtatgccttcgaggtgataaattaacttcagttagtgagggtcaacagggtgctcttgccggtgctgtggcagtttttgtgcaaaatgatgagcaaagtggaaatttacttctggccgagaatcatgttttacctgctgcaagtatcagtggaacaaataatgaaagtcaaggaggtgctttcaacatcagcagcaagtaaagttcatatatatatatatatatatatatatatatatatcactagtccctttcaaatgccgtgtgtgtgtgtatatatatatatatataaacacttaattaatttctacatatatatattgctgcaggggggtgttagcttacttgagtgcggcaagaacatatataggagtaaagccagctccaataatagctggattctcatccaggggtccgagttccgtgcaaccattgatactaaaggtctataatatatacattttgttacaccaacatgacatgatgattttccttcttacaattgatgactcgtgtgagataaacttgctgtaatttgtttctttttcagccagacataactgctccaggtgtgaacgtaattgcagcttttacagaaggagcaggtccgtctaatatcgcatcagatcgacgtcggtctcctttcaatgtgcaacagggaacttctatgtcttgccctcatgtcgctggcattgcaggtcttctcaaaacatatcaccctacttggagtccagcagctatcaaatcagctatcatgaccacaggtacataagtaatagctatagtaatatatatgcatgcttaattacaaaatactctcgtatgttacaaaatataaaatgtacatatgcagcctatcatttggaaaagcattggtggtttattaattaacaactatgctcttaattaattccagctacaacactagataatacgaatcaaccgattcgtaatgcatttgatgaagtagcaactccattcgaatatggtgccggacacattcagcctaaccttgcaattgaccctggactcgtttacgatttactcaccaccgattacttgaacttcttatgtgcttctggttacaacaatgctttactcaagttgtttgccaatttgaaattcccttacacttgtcccaagtcttacagaattgaagatttcaactatccttcaattacggtgcgtcatcctgggtcaaagaccataagtgttactcgtacagttacaaacgttgggcctccaagcacgtatgttgtgaatactcacgggccaaaggggatcaaggttcttgttcgaccatgttcgttgacttttaagagaaccggagaaaagaagaggtttcaggttatactgcagccaattggtgcccgtcatgggttgcctttatttgggaatttgtcttggacagatggcaggcacagagtaaccagtcctgttgttgtgctgtaatgtaaccttagcagttagaagttgctctcagcattgttatgttatcactgtcatttgagtgtgtttgcgttttctgtttttaggctgtaatatgtgtttcctactcctgtcgtattaaactttgtctaaactaataggtaggtcatcggagctatgtttgtaatgggcacactctatcatgtatggaacctgtatctttgaaagtctaataggcattgttgagagttgagacccatatctaaataatattgaacaattttaattaggctctaatctaccaatttgccttcaccattgatttctcttctttctattttatctcgtgcagtcatgcattcatcttcagttactatggttccgaaaatagaatatctctagtctctagattagtggctgaggctgaggccaagataacctgaggcatctgcagaggaagtagctgaggccacgataacctgagcctcgggggtgcaggatccgagtaaggcaagtgaaaaatggctaccttggtgatcccaatgcaggtattcaggattttgtgaccgcagagtctccagatcggcagatccaatagtgaatggaagacagggagtggtttatgtaacatctccttcctgattgttggcttttgaggaggtgcatgagttgcttgtgccatgtcgggttgggtgcaaggttgaacttaatgatgttagagttaggggagctataggcattgttggttgttgtggaagaggtggtttgggaggcatgtgggtcggaaaaaaaaaaaggattaacttaattatttattaacttttgaagaggttgtttctcaatgcagagatatatatgtgtgtgtgtggggtagtgtgtaatcatgcattgtaacatgaaattatttacgttgttgcctgagttagaaatggaatatatgaggtcaagcggatgatatatataaagattaacttaattattttgtattttaattttagtttcatatattttgaataagttattatcacattaaaatttattaatttttttaaagtaattgaataaattatatttattaatcaatattatatttattattatatttgttttaatttatatttttttttattttttaagtttttattataatattatacctataatcattaataaaatagagaaaaatgaagattaaattatagtttgagtaaacagttatttttatttttcagttgacaaattcgtccttaaatatatcatatatactctttcattattaataacaaatataatttaacgaatagataaatttctcacattttttcacttccagaaattaaaatttagattttcatatttaataaataaatttatagcaccctacatgtttaggaaaaaaaatatttatccaaataataataataataatgataaaagcatcaagtttgagacaaagggaagaaaaactagggttggcaaaacgggcctggcctagcctgcaaaaaaatgctagctggattgataatatcaactcgcaaatcaaaagcggggcggactagcccggcttgcaaaattgggggcccaacgcggggcggggcggggcgggccagcccgctggaccaatattatttaaatattaaaattaaataaatatatttaacatattttgaaataggtatatttttttaatttatattcttttgcactctcataattaacttctaagttttaatattaaaatgtttatgataatgatactttcaaatagtcttttattactagcatattacactttgaacagtttatatccgtaaattccatttacaaatgacgtaattttgtgaattatcacatgacatcatgtatttaacattaattttaaattatttacttttatttaactttgtgttttttaattatcatatttgtattttttataattttttgtattttttaaattaattaattaatttattttttattttttaggcggactgacccgctaacccgctgacccacattaaagcgggatgaactaatatttttaatccactttacaaaagtgagctggatcaatccgccccacattttttttgggtcggccctgtttgtcatcccaaattgaaaaacacggatagtgcctctatctcgtttccaaacacacttttccttactttattctgagtttcctttatgagctatgctaggcaactttgtttatagtgataatgcacttttcttaaagtgaagaaggataatttattttaaattaatcattagcatctcaacatatcatttatattataaaatatgtcaatttttttataatttaatttttttcctttttcgttcttgtaaaaaaatgatttaatccttataaaatatttttttcttaaaacgttttaaatattatttttttgttgtgcaaaacatttattttattgttcaaattacattctaaagcatttttaaaataaaaaataaaataaacatatttaaaaggattaaaacaaaaaaaatatcaagacaaaaatgaaaaaaactaaattataaataccaaacaagtatttaagcctatgattnnnnnnnnnnaaaaataattaataagacttaaaaattttaaagcatcaacaatggtaaaataaaaagttaaaataacaatatttatgaaatggagaaaaataatttattgttcataaaaatatatgtacataatacccacaaaccttttaaaaaattgatgttattataagcatatactactttaagaatatttaccaagaccttgttagaataagcatttcttaggatatgtttaatagaaggaannnnnnnnnntatattatgcattgtatatttgatcatttaaataaaaatatgagtaaaataaaaatatttgaaacatatgaatatatttatattccaaatataatttaacaaaaactgttttaaatatagaattcatggactaatatataaacttctgcttaaaaaatctttacaacaggttagtcactaatatcttaaccattaaattatatatcaaattaatatacgataaaaaaattatcaaatcaataaatctatgatgtaacttacccattgctgagaaagttattcacctccccattttagatatttctcctctttctattgtgttacaaactgatgccaatgcattgttaggcttatatagaaagatagtatttatataaaaattgaaaatatcgtaaataaatgataggaagcctagccctaatccgaataatttatgttgtcgacctgcgtcttctacagggccacaatatgttggaagagctgcaagcaggatctttatcaaaattgtcggtggtgctgttgcaatttgcaataagtaaaatatataataacagaggtaggcattgatgatgtcaatggtgtttatgtaatgaaaataggtgaaagttacgtaagatacagagctagaattaccctatgtaagagtgaatttaaaataaaattgtatttttttttttctaaaagtgaattactctctttgattttttttctctcaaaccaaataagaaaaatatatatggttatacatgttttctttttctttttcttttcttttcttttatttgtgctccttccaaacggacccttacggagtcatagactctttttttgtgaatgacatatggtgattggtggaagatgacgtaggcaaatttcgaaagccaatagtaaagcattatgcgcaaagaccttcactaaattttataatatatacacattgtttgcgtcttatttttttttattacatcacattattttctatatttttcaactttatttggtagcatgatatatttaccaatcagtaagtatatataatgatttatttttcatattaaaatcatgcttatggaaaatggtgaaagcggagttatattagggagcgatgatagccgtatgctctttttggtagttgcgtgtatgaatacaaaaatatagttaacatccatatcacttttaatccaacttaattgagttgataataaataaacttaataataaatataaaaagattaaaaaaagaaaaaaataataaaaaaagaagagaaagataaaaaaaagaaaatgactaaaaatgaattatttaaaatataaagataataatagatttagttttccgtaaaacataattttccatttcatcttaagacgaatcgtctatcaatctatatatcacttcattaagtcttatttaattacattttccatgtaagtttcggtatatatttatctctctttatatcgaagtcttggtaataaacttttattcttaagaaaggatccaagtactgtttcattacgtgtagaaaacgcctcaaaataatagagagaaaaaatagaagaagaaaaaaaatgatagatatactaaatgatattaatagctagtgaacaatgaagagagaaagaaaagaatagaataaaattagggtaaataatcattttgtccttaaatgtgtagagtgttgataaattcgttcatgaaagatgaaaattcaattttttgtcctcaaaaatgtaaaaagtgcgaaaaatttaacattccgttaacttttatctattatcgttaatgaaagaacttatgtggcacaaagagacgaaaatgtcacaaaaatgattaccaacacggctgctgactggattttggatgaaaatatcagtaagttatcattggactaaaatgtcagtaaattttttattggacctaaatattagtaagttaccattagaccaaaatgttaataattttcaattggaccaaaatattagtaatttttcatggatcaaaatatcagtaatttttttggcaaaaaaggtcagtatgttttcattggaccaaaatgtcatcaagttattattcgatcaaaatgtcaataatttttcattggatcaaaatgtgaataattgtttattggagaaaaatgtcaataagtttttattagactaatttttcagatcccaaatttcatttaatttaagggcaaaatatagcttaagaataaatcttttctctttttttatcgttacaataataataataataataataatataaaaatcacttaaaaataaggaaacaaacataagttaaaagaaacacaataataattatattattgattaatataatcataatttgtctgtcacaatataaattattttggataaatttggataatagattgtgactaataatcatattattccctcgtttctattgattaataaccatactctttcctatcttatttataatagattttgactaattattataatatggaaaaatttgtaatgattaatacattgttacaatgattatctttggtacactggtagaatatttattttagataatttacattgtgacagacaaattatgattattaatcaatgttatgattattattatgtttcttttaacttatgtttgttttcctattttataagtgattattgtattgttcttattatgtttgtaacgataaaaaaaagaggaaagaattaccattaagttatattttgttcttaaattaaacgaaatttggggtcttacaaattagtccaatagaaaggtattaacattttcgtccaacaaaaaattacttacattttcgtccaacaaaaaattactgacattttgatctaataaaaaattgttgacattttgatcaaatgatgacttaatgatattttggtccaatgaaaacgtactgacctttttggccaaaaaaattactgacattttttgtctaatgaaaaattattaatattttttgtccaattgaaaattacgtatattttggtcaaatagtaacttactgacaattaagtccaacataaaattactgacattttagtccaatagtaacttattgacattttcatccaaaatttagtcagaaatcatgttaacaaccatttttgtaacatttttatccctctgtgtcacgtagacgctgttattaacggtaatggatagaagttgacagaatgatgattttttttgcactttttatactttcggggacaaaaatttgaattttcaacttttaaaaacaaatttatcaacgtaatacatattaaaggatgaaaatgactatttacccataaaattaagatggaatatatataagcagagccacagccatggattacatccacaccaaaacaacaactaaagatatattatggcattctccatcttcaaacatgttctgtcattattccttctctgcattttcttgcaggaacctaccaatgcccttagaaaggctagtaagcttttgccttttagttcccccgttacggttatcaataaagaatctgatggagtttttccatcatctcttcaagttccaacttcgagaatttccaaatttatattttgttaattaatgtaccataaaacatctcaccaattgtgtgctttgaattctgtgttttcagacctacattgtgtacatgggaggacattctcatggtccagaccctttgccaagtgatcttgaaacagccacaaactcccatcatgatttactggcttcttacttaggaaggtaaaacaaatgttaagttctcttaaatattattaggacgtgcgtgttaattaaaatttgataatttaacagtcatgagaaggccaaggaagcaattatgtactcgtacaataagcacatcaatggctttgctgccctacttgaagatgaagaagcatcacagattgcaagtgagcaaagactattaccattaacatgaccatgattttctactcatcttgaagccacacaaattgatataataatgtattacatgtttctattggtacagaaaatccaaatgtagtttctattttcttgagcaaagagcgcaaattgttcactaccaggtcatgggattttcttggactggaaaaaaatggaaaaattcctgcaaactccgcttggaggaaagcaagatttggagaaaatataatcatcgctaatattgatacaggtatgcttagttactctcttttttatcacagttcatcgtgctcttaattcagtttacattattttcttcttcatgaatttgtactgcaaacatattttccttttgtaaatacgtaagttgcttcttgaacaggggtttggcccgaacaccccagtttccacgacaaaggatacgggcctgtcccttcaaagtggcgtgggaaaggtgtctgtgagatcgacagttttaatggtacaaagagttatctatgtaacaggtaatttttctgttatttcatttcaaaaattgggttgagcgtgaaataacatatgtattttaaaacgttgtgattatcacggcaatggaaggtagttgttattttatttacagcttaattaatgttttatctgtataattttggctcgtattactttagttcgtttattttaaataaattcacaattttaatttaatacttaattttgcactctttttttgattaattaaattgttttttagttgttaagtgtgcaattttcaatcctcaatgttagttaaaatataaaaaaaagtatgcaaaattagaattaaattaaaattgtgaattttataaaataagaaaactaatatcatgaaaaaaatagagatcaaaatactagattatgatccataggcgattaaaattataatttagttattctattatattacgtattttgtgtttattaaggatgtgtttgaaacgaaagaaaaactaccaaagtataccagctggatagaaatataggcgtaactattctactatatgtatttttttaattttatgttaattaaggatgtgtttgaagtaaaggaaagattgtgaaagtatactagatggatatatagaaactataattttaatcaaataagaatactattttttattaaggagctcgtacacaatgactattgtggtttcatgtgaaagagtcttttttttaaataaaaaaaatgctctgccctacaaatccaaattcagacaagaacaacaataccccaatcatttttccaagagtcacaagaccaaaaataaataaatgagtatcataatagcatgcaagcaattttggagccttcagctcttctaatacacatccacaagtttaagtattttggattttttttatcataacattattattttataaaaatttatgatatattttttaaaaatattataaactatttattgctcacgttaaaaaaaattcttgaattcgccgctgttaattgctatcacatgtagccataatattaaagaggttggtgttggataagataaaagtatgatggatttgtgtaatttcggaaaactttataaatagttatcttaatttactttaaatcatattatccatccaaagatagaggagaaataaaatgctagaatctagctagacctagtcatgataagttgtcgttttttaagagtcatgataagttgttaacgtgatatttactgggatatgttaaatttacgcttgcaaataaaatatgtaaatatcatgcaactttttttaataaagaatagtgatatttggacatcaataattttttgatgttatttggacaccaataacttacagacactcattttttttgtcttaatcttttgattcatcatagaaaatggatcttctttaatccaaaattgtctaactaaaaatcattttcaccaatacttgacctccgtacaacatgaacatttaatttcaaccttaattattcatgctcaatcatttgattttacaaaaattgataatatctcaacaattcaattttaatttcagtatattaactattaatactcaatcacttaattttacaaacactcatattctctttctatcacatcatatcattaatcttattaattatttatctctcatttctttttatctctcgttaagatatctatatcctctatgtgtccaagaatcatttctctttaacaaaatcgggtaggaatatcttataggcctttgtttacgagcatatttgatatggatattttatatagggtaatttaggcgtgactttttctttgccacaaacatatgcatatgtttaggacttaggagcaacatcgcaagcctcatggtgaatattggccagtgtatatatctgcactgattgctcctttgaatgacagaacaaattctataccttctaacattcttacattagttgtgttggcaagctaataaagaatacctgtaatgatttagttcgatcagtttatcattggaaattttgttgtcagtaacaaggtagaacggcctataatattatgaatattcaggaagctgattggagcaagaactttcctaaaaaatcacgaggccgaagttgaaaagattgacccaaggctacgcagcggacgtgacttcgtagggcatggtacccacacactgtcaacagctggtggtaattttgttggtggtgcaaatgttgaaggtaacggcaatggtactgctaagggaggctccccaagagcacgcgttgtggcctacaaagcgtgctggcataaactggacacaggagggtgccatgaagcagatattctacaagcatttgattatgccatgtatgatggtgttgatgtcatctctgcctctctcggttcgtctaatccttataccgaagctttgttaacagatgggatatccataggggcattccatgcagttgccagaaacatagtcgttgtttgctctgctgggaatgatggaccatcacctttaagtgtcacaaatgttgcaccctggtccttcaccgttgctgctagcacaatagacagggattttctcagcgacatttctctcagcaacaatcaatccattacagtatcatctttttatacttttccttaatttattagtttcatatgtttttattatgtcaacttaattaattggaatatgtgtgtatgtatcagggtgccagtcttaatcgaggcttgccaccatcgtcaccgtcgaacaagttctatcccataattaattctgttgcggctagacttcctcatgtgtctattaatgatgcgtaagcacaatttttgtttttatttcccaagcttgcttcaaatatttatatgtactttgtctcataggtgtatatatatgtatatatgtatgtttgttggtgtagtcgtctttgcaaaccgggaacacttgatcctagaaaagtaagggggaagatactagtctgccttcgaggtgataaattaacttcagttagtgagggccaacagggtgctcttgctggtgctgtggcagttttagtgcaaaatgatgagcaaagtggaaatttacttctggccgagaatcatgttttacctgctgcaagtatcagtggaacccataatgaaagtcaaggaggtgcttttaacatcaacagcaagtaaagttcatatatatatatatatatatatatatatatatatatatatatcattagtcccttttaaatgtcgtgtatatatatatatatatatatatatatataaacacttaattaatttctacatatattgttgcaggggggtgttagcttacttgagtgcggcaagaacatatataggagtaaagccagctccaatcatcgctggattctcatccaggggtcccagttccgtgcaacccttaatactaaaggtctacatacattttgttaacatgtcatgatgattttggttcttacaattaatgagagagataaatttgagataattggtttctttattcagcctgacataactgctcctggtgtgaacgtaattgctgctttttcacaaggagctggtccgtctgatcttgcatcagatagacgtagatctcttttcaatgtgcaacagggaacttctatgtcttgccctcatgtcgctggcatcgcaggtcttctcaaaacatatcatcctaattggagtccagcagctatcaaatctgctattatgactacaggtacgttcattaccaaagtaatatcgatataaaatcttcatgcacaccaaatcattggcggcttattaacaactatgtttttttatcaatttcagctacaacactagataacaccaatcaaccgattcggaatgcatttgataagaaagcaactcccttcgaatacggcgccggacatattcagcctaaccttgcaattcaccctggacttgtttatgatttaagcacagccgattacttgaacttcctatgtgcttctggttacaaccaagctttactcaagttgtttgccaatttgaatttcccttacagttgtcccaagtcttacagaattgaagatttcaactatccttcaattacggtgcatcatcctggctcaaaggctatcaatgttactcgtacagttacaaatgttgggcctccaagcacgtatgttgtgaatactcactggccgaaggggattaaggttcttgtgcaaccaagttcgttgacttttaagaaaactggagaaaaaaagaagtttcatgttattcttcaggccattggtgtgcctggtcacaacattcctttatttggaaatttgtcttggacggatggcaagcacagagtaactagtcctatcgtagtgctggacacttaaaaattactctcagcattgttatgttatcgatcattgtcattttaatttgtttgcttttgttgttttttaggctgtaatataagcgtgttttctgctgatgttgcattgaagtactttgtcacaaaaaataaaaggcacaatgaacaaatcaggactgcgggatgcggtgattaaaggttaagattgttgtgcctgcatgtaatttggcatatttaagattattgtttccttttccttttgtgaaaaaacagattaaactttcactatttaactgcctttttctactcgatcttagcaacttgttcttttccttggtgtctcataaatcaaacacggagtcatgatgatatttacttgactttggagattgacttgatccaaaaatccaagtcattggtggctataattttgtaaatttaattaataggttaagttgtaaatttaatccctaattttttaattcatgttggtttttcttgttttaatggtaatatttggttttttagttttataaatcgataattttaatctccttgataaattattagtcgtgattaatagaattattaagttaattatatattaattaaaaatcattaactattaaaactttaataaataatattttattaatgtttttaatgattaataatttttatttaacatataattaatttaataattctattaattacaattattagttaataatcaaccaatgaaaccataattatcaatttataaaattaagagaccaaatattatgattaaaaattaaaaaagaccaaaatcatgaatttaggaaattagaagggatcaaaattacaatttaatctaattaataatattgtaagcaaattattgatccttgtcattcagttttgtgaatttggtagtctatgtatgaaaggaaaaattctttgtaaattacacacatacttcccttaaagttttcatttattatattaagcattctttcagtttttcaccctacaaaaatttccctaatttaaatatttaatggctctcataacagcagctacccctcactctcaaacattcttaactctgttaacagaagcgcacacgtgactgacacacgggtttttaattatattatgtttcaactttcaagaatgtcctttatttgctactgatttccagcacatgaaattgaagcactgtccaaaaatgaccatttcattcttaaaccatttatttgatctgaagttcacttaactataaacgaaaaaattagaagataaatttcaaaaacaaattaagataggcaatgaaaaacgtgaataattttttttcacacacatctgcttcccaatccgctcaaaatggcaagtttaataccatacaaattcttcaaaactggaaatttcttctgtgaaattacaagaacaaacaaaactaacgtctcagtagtttctcaatgtattagattcttttatatatctcgcagatatagggatgtcgtataataggtccaaactttagggagagttcttgtaatttatgtttgttttaaatataaactaaacgttaaggatatagcctatgttcctttcgtgtctgctcaaattgagatggtcttagggaggtaaacattgaacatcttagactcaaaatctaaagtttctctgcttaaagatggccgagtatttttgcttcttgttgtgtccttcttccttcttgttgtatcattcttttttgaatgtcctttcttattacttggcaaaactatccttagaaaggtgaactacttataaaacacactatcacgctcaaattaggtctagcacacaaagaataatgaatgtagtaaatgagtggatagaataatctgtattatatatcttgaaaacttaatcctttatatatatatatatatatatatgtatgtatttattggccttacctcttaattgaggggggcataatatgaaattacatgatgatattaatatagtattaagataagttaagctaaatttcttaactttaatggggtagttgagaaggtactagactatgctaaagggattccaggttgtaactgacaaagtattatgccatgcttaagggctgcataggtcacgccgaagaagacacgttagaatatcacaattcataaggaaaatatattatgtttactcttaaatattcatatatttatttgtaaattttttaagatagattaataaaaatatatttataattaatgtcaatctaacttaaaatatattaagaatttaagatattatttaattaaaattttaaaaataaaatttaattaaaatacactgtcattcatatatctatttatatataaaaatattatcatatatgacaattttttaataagtaatttaaaaattatatatagaatgattttttattaatatgatattaaaaatttatattgacggtgaatgaaaattaggctcttaaaaaaatatattttttggcttaaatatatttttcatttatgtaatatactattttttatttaattctttataattttgtttttcaaaatggacattgtaaaatttcctttatagttttagtctttgttattttattttagtaattataatgcactgttttttgttttatttcttataatatttatttatcttgaaatattctctttgaaaaatatttaataagaactaaaagaaaataatatacatattacaaggaaaaataaaataaaatcaatatattatcatgaaagctgacataaatcatgaaagttaatcaattcactcatacacatttaattcacaaaaacatcaatcaacaagagtttgtattcaatcaagaatcataaattcaatctcaatcatacgatcgattaaatcaaaacatgctcaaacagtctcatcaaaataactatctattatgcaaaattaaagaaaccgtaaattgcagaatttaaataactggagtgcaaaaatttaaagatagatgcagaaaataaaataaggaacgaaaaaaaaagaataaatctagaaaaaagaaaaagatggctttaatcctgtgtcgaccatggattccacgctccctaagtcggtctgacatttgcaatgtaatcatcatcctctcaagcctccgcaacatctatgtcaccaaatggtccattcgcagctccagagacaacactcccccaaagaagaaggcttgtccccaggtcaagcaactcgcttgaggaagtcctctagagtcgtgatcggctgatggagaaagagttgatgaaggctctgcatcaggagatattgttcgtggggaaggctggtcagcatggaaagaagtggctcctgaatacgtggtggagaggcagaccctcgttgttttctagtgaccatctttaaaggatagacaaaaatgagacaaaagaaaattaaattcacacaaaaataaaatatttcacaaaaatagagaaaaaaggtaggaatgttggcttgcctttcagtaaatgcttctttaacatcactagcttgactagcaaaatgccttcaaggtggcatgaaggtcacatagaacacaccttcctcttgcattttcgcttcttagctagagacttcatgaaaatcatgtatccatggaacgactttcatatcattgcaagggaagtgttggtgatcaaggaaaacatggcactgctgaatttatcacattctccatacctttctttcttgccaatcaattaatgaggagaggtattgacttggagatgacttttttgttgaatttctacgtgtgagcactgctcccattgttgttgtgttctttcttcacttttcttttttttttcttcatctttttcttgtgaatcatgctagctcttctacaagattctcctcatgtgttgtaagctctacaaaattttcttcctttgtgatcaaaaaagacattttagccacttcttttactagcttaccaacttgaatctccagattttgaattgagttttgattggctttgaatctagcttgggaagtttccatgaattgcataaacacattcccaagattagagattctttcttcttcatattgattgaaagggtataactattgttcccaccaagaatttttcatgaagtaaatatgacaattatcattgaaatgctctcttccacaaaaatcacaattgataggttgtgggtgactaatccctatgaattgcatcaacagattatcaagattaacgatttttttcttcttcatattgattgtaagggtgtaactcttgctcccaccaagaattttccatggactaaagataacaattatcattgaaatgttctcctccacaaaaatcacaattgataggttgtgggtgactaacccctatttacatgattttaagatgctcagacaacatctctgattggttaacaagaagcctttgttgtctgagcacactactccaaatatcttccatggatcatattcttcaaaggtttcagcatgtaagcatagactcaaaagaaaaagataatttttttaaaaaataattttatttttaaaaataatttttgtctttaattttttttcaaaatttgtttaccaaaagggaaaataaaataaaataaatgctgaaattctataagataaattagaaagatattaaatctaataagataaagataaaagataatataaaataacaatctaacaataaaatctagaaagataataattatgataattttctaataaatttaaagataaatacataatctaatccctaaaagataatataaaataaaatctaaaggatttaaattttgaaattcaaaaaaaaaatcttgatgttaaaaataaaattaaatgcttaaaacaagggtatacaaactaccgaatacaaggaacaaattccccgataatggggtcaaaaattacttattcgacaaccgtaccaattcgtctaaataataataaaatgataagaccgagtgtcgagtccacatggactttgattatactcaaaatttgtatggtctaattgtaagcaattaacataataattttgggatttgtagtcttgcatgtgataatataagtaaatataaatttaaaataaaataaattaagaaacatattataagaaagagaacacaagcacttgaagatgtgatttgaaggttgatgtaggcttatgagatatgttgggtgttaagcctaccaaaactactcttgatgcaatgttaatgatttttcactatttaatattatttttcatattatcttcatctttaatttattctaaccatgatctctcatatgaaagaacctaaattacctaatttcaatcatgatccctcaacaagctacatcaaataatttataaatcctcataacattacatgcatatgaatgaccaaaccacaaatatgataatagtttcataaaagaataataatatgaaagtaacactaaatatagatagtaataactgttacatcaagagtgtttggttgctaaatcccaacaataagtgatttagcttctcattgacatcatagacttacaaaaacaaaagagaaaaacaattgatgaaagagagtgaaaaaaattggtagaacaagggacataaatccatttatgtagaatgaattcttctttcctttgtgcctttggtttctctatctgacttccctatgactgctcccatttttataatcaaaactttgtttaattagactttttttttatattggtgagacgctaggccgatgtgtgcgcactaagtccatatcctcaatcaatctttcaagtttttaatgtgtaatcctaaaaaaaaaaatacaagtacactacaaataaactaattttagtatttcttgaataaaagctcataaaaagttgaatttctatattgcaatcacaaaagaaacaataaaagaggaaacagaagataattaatatataatttaaatgcacaatttccttataaatagcaattatcaatggtacctttagtgttagctaaacaaacgttattagaattgttccttgtttttaggcaagaattgttctttttataaaccagcaaaaataataaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaattcaagtacgaaatcgattagaggtcaagttccctacgtgaacagtaatggtgctagttgtataaacaatctggagagggtattatttgcgtaattattttttattttgtattatttgagtaaaaaaattaattgaatgatttcttatttattgatagtatacaaatctttatttatatgcaatagaatctttatttacataaataaatttgttaaccttttacatgaatgtttttttcctctatttatatttataaaaattaaaaaatgtctctttgtcctttttaaaagaataataaacataaaaacgttcaacagttttaagcataattataatttacaagtggggaccacaatttttttttggatttggatgcattaactttacacagtagtaaaagtcactatcactttgactattagattaatcttatcatccaaatttcactacttgttttaaaagatattttttgatttattttttactttagttattaatttatcactttttactttaaacctataaaaaatacaactaagtgtgtagattaattgttacgaggtatttcaatttagcacatggttgaggagaaattttatcgccaataaactataaggatcctatctacttcaagcatgattacatttgatgaaacataccagtggtctggataaaaaaaagtcagaaattttgtagcatgctgctaggaatttctttaattttctaaatgatataagagactatggattaaactgaaataattttgtactagttagtagttaatctataccctcaacaatatttttatggttttaaaatatacaagatataaaaactaaattaataatcaaattaaaaacatctttcaaaacaaaatcgtaaaatttgaactatcaaattaatctaatattttaaaatgagattaaaaacatgtttggatataagtttctctataaatatttttagaagaaaaaaataagaaaaaaaataaaatgagtttcttcataaattaaaatatattttttattaactaatttgtagatgtcatatcatcttttaaaaaagttatattaatgagcttctaaaaattaactaattgagaacttatttatatttatgaaaaaatttatatcatttttttctttaaaaatatttctaaaaaaacttagccaaacatgcctttaagtaattataaaatgtccaataaatccattccatgttttctgaggctacactcggtacgtaatttcacattaaataggagcagtttttctgctatttcattacactatcatctactagctctgatcgaggatccatcatcttctgctattccataatcacccaatagctcaaatatgatgttctctaagctttcattaattcgtctaattctctgttcactcttaagcctccactcctcccaacttttcaagtttacttcttttgcctttgctgccatcactgctgaaaaccatgagagggaagcagctgctctacttgggtggagagtgagtcttgacaaccaaagccaagcttctttgtcatcatggtccagtgctgtaagtccttgcacgtggaaaggaatcgtttgtgacgaatccaactatgtgaccgctataaatgtggcaaatctggggctaaaaggtactcttcacaatctcaaattttcatcttttcccaagctgctaactctggatattagtaacaacagttttaatggaatcattcctcagcaaatttctaacttgtctagagtttctcagttgaaaatggatgttaatctttttcatggttcgatccccatttccgtgatgaagttggccagcttgtctttgctagacttaacaggcaataaactttctggtaccattccatcaattagaaacttgacaaatttagaacaccttaggctcgcaaacaatagtctctctggtcccatcccaccctacataggagagttggtgaatttgaaagttcttaattttgaaagtaatagaatttcaggatcaattccttcaaatattggaaacttgacaaagctcggcatattattcttaggcgataacatgatctctggatccgttcccacctccattggaaacttgatcaatctagagtcgctggacctgtctaggaatactgtttccggagttattccttctacccttggaaatttgacaaagctcaattttttaatagtgtttaagaacaaacttcatggtacattaccaccagcactgaataactttaccaaactccaaagcttacaactatctacaaatcgtttcaccggtcctttgccacaacaaatttgcatagatgggtcactgagaaaatttgctgctaatggtaattctttcaccggtccagttccaaaaagcctgaaaaattgctccagtcttaccagagtaaacctatcaggaaatcgcttgagcggaaatatctcagatgcttttggtgtgtatccagagttaaacttcgttgagctgagtagcaataatttttatggccacatttcacccgactgggcaaagtgtcctagtctcacaagccttaggatatccaacaacaatttatctggtggtatacccccagaactcggccaggcacccagcttacaagtactagtcttgtcttcaaatcatctaacaggaaaaattccaaaacaacttgggaacttgacctctttgtttgatctatcactaggcgacaatgaactttttggcaacattcctactgaaataggtgctttgtcccgcctcaaaaatttggtgcttgcagcaaataatttaggtggcccaattccaaaacaggtgggatctttactcaaattagttcacttgaacttgagcaacaacaaattcacagaaagcattccttcatttaaccaattgcaatctcttcaagatcttgaccttagtaggaatttgttcaatggaaaagtaccagcagaacttgcaactttgcaaagattggaaactctaaacctctcacacaacaatctctctggagccattcctgattttaagaatagcttggcaaatgttaacatatctaacaaccaattggagggttcaattcctaacattcccgcctttcttaatgcttcatttgatgcattgaaaaataataaaggcttgtgtggaaatgcctccggtttggtgccttgccaccccctacctcatgataaaatgaaaagaaatatcatcatgttgccattactcctttctttcggcgctctatttctattattattggtggttggaatttcgttttgtatttgctaccgaagagcaacaaaagccaaaaagaaggataaagaagatcaaaccaaggatcattattccctttggagttatgatggaaaattagtgtatgaagatatcattgaagccacaaaggggtttgatgacaaatatctcattggagaagggggaactgcatctgtctatgaggcaaaattaccctcgggacagattgttgctgtgaaaaaacttcatgctgcacccaaagaggaaacaccagattcaaaagctttttcaactgaggttaaagccttggccgaaatcaagcaccgtaacattgtgaagtcacttggatattgtttacatccacgcttctcctttttggtttatgagttcatagagggtggtagcttggataaagtactaaccgatgatacgcgtgcaacaatgtttgattgggaaaggagggtgaaggttgttaaaggtgtggcaagtgctttgtaccatatgcatcatggttgctttcatcctattgttcaccgtgacatatcaagcaagaatgttcttatagatttggattatgaagcccgcatctctgacttcggaacagctaaaattctgaatcctgattcacaaaatataacagcgtttgcaggcacatatggatattctgcaccaggttaggccatttttgttcttaagaatttaatcctatatatattattgtttcaataataagtcctgctacttgctttataatactatttttattattttgatgaattacagagcttgcttatacaatggaagtgaatgagaaatgtgatgtcttcagtttcggagtgctttgtttggaaataataatgggacagcatccaggagatatcatttcttcattgttttcatcatctgcgtctaatatgctattaattcatgtgttggaccagcgactacctcagccagtgaagccaattgtggaagaagtgatcttgattgcaaaattaacatttgcttgcttaagtgagaatccacgctttcgcccaagtatggaacaagtgcataacgagtttgtgatgccaaaatcatcttctttggatccactccccatgatcacacttggtcaactatctaaataattgaaacttgttttctggtgtgttgtatgttttttagttttttggtttacactgtaattaagcttttcgtgatattaatgttattctcttgcatgttttgtatgtttgtgatggagtgctttgtatatttcttctgttctgtgaagacttggaaaataatggaaagttgcctatgtcttttgtaagatcgaataaataaagtgtgatttttgaagggagacagtcatgtttttggtctttataaaataaataaagttgctttacataaaaataaataaaaaagctactttatcaaaagaaaaaagtaatgtttttggtaagataaggatattttgactgtatatttctttgagagttatttggcgttaatggttagccactcgatgaagtatattgaatttaattgaagacactcccaagtcccattatatattaggactttagtaatctacaagaaaactcgtataaggatattttgaagaataaatttgaatacaaatgttatatatttcacacaaaactattaatcggatcattttattttatttttcaaatagaaaaaaattaagattatttatgactgatatctgcaacaaagtttaatcaattaaacattttattaaatcaaatgtcaattgattaaaatatttatttttataaataatgttctattatgaattttgataaataaatgttatatgaaattttcataaaatgagaaattaattaaattaaattaagtagtttgattggttcaaaattaaaagctttattcattattataaaatataagaaactaatatatttaagagattaaaaacatatttaagattaatatgtttgtaaaaataagaaagacaataaaaatattttagtaaaatagatttctaataaatattatgatattggagttattatttttattagcttatgtgaaaaaaatcttatccctaccctagtatacatgtcatgtcgatatctcgcggttgttacaaaaggaagtcgttcctctccaaaaaaaagaaaaaaaaaaaggaagaagaagaaggaagtcgtttcttggggtccaccaaaagaacgaatgaagttgtctttcgataaatcaatctgagtttttgtgccttattcaaccaatcaatctaagaaaaatataactccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaatcagatgcaatattattattttttttttgtgaaaaacaggagaaaaccccaagaacactaaaatccgcaagaaaaccccaagaacactaaaatccgcaagaaaacacggtcttacaactttcagccaaaacggtattatacaaaaaaggaagggacaaaatcaaataccttaactgcctaatcaaaccagaagcaatttgcgattacagctcaaagaagagtcggacttatacacgtccctgttccaaaataaacaagatcatattattgcctgagctagaaataatgggtagatgaagattgaaggggttaagagtttcatccttaggatagtggtgcaactttggtgactttcaattgtggatttgcattatgggaattgtgacagaagccttttttttttttaataaacaccttcattaatcattatagaactgtgtttgataaagtttgacatttggagagcatttctcttaatttttaggctttggagaatttcatagtagttttaaaaattcttaaatcattttttttaaaaattaaaactctcaaacaagaaggtgtcaccacctaaatttttttcttcattcccatctcctttaaaatctcttttccaaacaaagtcttaaggtttactctgaatttatccgctaatataaagaaccgcttattacaaataatgtacacactatttccaaaattcttcaagatacatagtgatgtcacacgggaaggattcnnnnnnnnnnatatatatatatatatatatattacaagaactaaagaaaaataacaaggaacaaaatcaataaaaagaaattccatagaaatcattttgaaaaaaacaattttttaactactaaaaccataaaaacaatatatataccggaactgaagagatatttaagccataaatttatatttaacttcattgactaatatgtctattcaatttcgcttaacaatcaaaccatatatattaatgcttatgagggaatcatatttgttttggaagatatgctcttgaagcacttgaaccagcttggatctagacaaaccaattacaataaaacctactaaatcacgtatgggtttagggaaatgatattttaaattataaacattatattaatatataaatattattaaatacatatttgaatattaattaataatattagtactaaatttacttcacatataatatttattaaattgaaaaaaatacatggcctataatttcctaattatttagtgataactaataacatcaatcatgtggtgataaatgataacaccaccataactcataccaatagttataatttattatgggtctagctcaattatatttgagtaaaatttttgtaaatcttataatattagtcttcaataataaggaataaaaaaataattataatgttgattcaattttctgatagattttctactataaaacaggtaactatgtcactcttaattatgtatttgcactgaaacatatccctaaattaatcattggagggaaccttgtaatgcaagttccgaacacttgagaaatctcgagttctcgccggcgagggttttattatttgggaatattttatttcatttattatcatttttggatctatttcaaataattttctaaaaagataagtcataataggtattagacttctgagttaaaaatcataataaatattatgacttataatttttttaactgaagtcgtaaaaaaatttatgactttaatttaatttttttaaatttacaattttaaaattgtatttttttttacttttaaaattgtaagttataaatttttttacaaacttcagttaagtattgttttaagagttacgactttgaagttatatgatttttttctaaattatgtatttctattttatatttttacactttaaaaattagtattttgtttttttttgtttatcttttttaaaaaattgtaaatatctttttaatttagttatttaaaaataaaagtatttttaatatgttttatatattttctataaaaattaaaaaaaaatgaaaaatatataaaaaaaacttagtatatgaatattaattcattgaagtcgataattgattcttatctgggtagcaattcacccaaaaaatcttatccgtgtagcaactgccgttaaattgtttatacggcatgtgatgcacacttttcacacgctacaggagacttctttatttttcaaaaaaattatattcaaataaaagctaactggtttaggatttttcttttttaaagaaagcaatcatctttatttttttaaaaaataaatccttcataaaagctgaaaacaaaatattagctaatcaaaatgcattgcttcaacatatgcttccttaattccaaacaggtaaagcactacttcgtctccgatttgaacgttattaagtaatagtagagttgttggattgaaaattaacaagtctgctcttagttctcaaccggtgaaacatgtgattattatctcaaagtctcacttaaaattgaaccgtaaagcataaataggatgtttaacaaaagaataaaattgtgaacgagtaaagttagattttgatgtaacatttcaccaaattgggtcaattgtcatagtctaacaagccttaaaatgtctagcaacaatttatccggtggtaaaccgccagagctcggccaggcacccaaattacaacaacttcaactctcttcaaataaaattagtggaaaaagtccataaagttttggtaaattgaccctgttgtttgaactctctttgagtcacaatgaattttctaactacattcccacagaaataggatctttgctaaaccttcaacatttgaaacttgcagcaaatagtctaactggtccaattccaaatcaacttggacgactgctcaagttaattaattaacttgaatttggcaataataaattatctttgtggcaacttgttaaatggacaaatactagatcacttggaaagttgcacagattggaaattttgaatctctggcaccattccatccaattttaagaatttgttgagtttgacaaatgttgacaccaacaactaattagagggtccaattcctgataatgttgaaggtaacggactaacgactatggtactgcaaagggaggctccccaagagcacgcgttgtggcctacaaagcgtgctggcataaactggataccagagggtgccatgaagcagatattctacaagcatttgattatgccatatatgatggtgttgatttcatctctgcctctctccgttcgtctaatccctatactgaagctttgttaacagatgggatatccataggggcattccatgcagttgccagaaacatagtcgttgtttgctctgctgggaatgatggaccatcacctttaagtgtcacaaatgttgcaccctggtccttcaccgttgctgctagcacaatagacagggattttctcagcgacatttctctcagcaacaataattccattacggtatcacctttctatatttatccttaatttattagtttcatatgtttttatcatgtcaacttaattaattggaatgtgtgtgtatatatcagggtgccagtcttaatcgaggcttttaacaagttctatcccataattaattctgttgaggctagacttcctcatgtgtctattaatgatgcgtaagcacaatttttgtttttatttcccaagcttgcttcaaatatttatatgtacctgtctcatagatgtatatgtatgtatatatgtatgtttgttggtgtagtcgtctttgcaaagcgggaacacttgatcctagaaaagtaaggggaaagatactagtatgccttcgaggtgataaattaacttcagttagtgagggccaacagggtgctcttgctggtgctgtggcagttttagtgcaaaatgatgagcaaagtggaaatttacttctggccgagaatcatgttttacctgctgcaagtatcaatggaacaaataatgaaagtcaaggaggtgcttttaacatcagcagcaagtaaagttcatatatatatcactagtccctttcaaatgtcgtgtgtgtgtgtgtgtatatatataaacacttaattaatttctacatatatatattgctgcaggggggtgttagcttacttgagtgcggcaagaacatatataggagtaaagccagctccaataaaagctggattctcatccaggggtcccagttccgtgcaaccattgatactaaaggtctacatacattttgttacaccaacatgacatgatgattttccttcttacaattaatgactcatgtaagataaacttgccgtaatgtgtttctttttttagccagacataactgttcctgttgtgaacataattgctgcttttaacacaaggagcaggtccgtctaatattgcatcagatagacgtcgatctcttttcaatgtgcaacagggaacttctatgccttggcctcatgtagctggcatcacgggtcttctcaaaacatatcatcctacttggagtccagcagctataaaatcagctattatgaccattggtactaataattgaaattatacatttgaattacataataattttttaaaattatataatagttatattcttttttaatgtttttttttattgaaacacataaatttagttttttttctgaatttttattcaataaatactaaaattagttgatttataatgtattagttgtattttctttgtatgattacataataaaaacttgaaatatggattgagaatatgaacttagcgtgcacatatggacttagtgtgtcaccaatataaaaaaaagtatagttaagtaaagttttgattgtaaaaaagagagaagagaaaaatcatctgaagccagaaacctaagacacaaatgaaagaaaaattcacacaacaaaagttgacttatgtccctttgttttctggtctttatccattcttttttattaattattgtttccttttgtttttgtaagcctataatcagaggcgaatttagaaaaataatcaaaagagacactagtggtggactcaggaaaaattatttatgtctgcataagaatttttttttgtaaaaaaaattaaaggaacaaacaattataaataataatttaaaggaacaaataaatagtcagaccaaattattgttctagattaaatagaacaatgaaaacaattcattttgtactactagtctacatctcaatcaccttctcatttgagcacaatagtacagtgctaaatcaaacactaaaaaactaaaaattgtggcagacagatactaaataaaacactaaagttattccatctcagttcacaaatcacaataatttagtttgtaatataaagcactaaaaataatatgtccagtaaaaaacacactcacatagaccagtttgtatttaatagaaaaataaaaaaaatattgataatttaataggaaaatttaaggaggatacttcccgcaatcatgtacctaggatcccccagtgcctataatgacaaagagagactaaatcctacttggagtcgagctatcaaatcagcaattatgaccacaggtacattggtattagctatagtaatatatatgcatgcttaattacaaaatactatcatatgtatgtagcatatcatttggaaaaacattggtggcttattaattaacaactatgctttttatttatttcagctacaacactaaataacacgaatcaaccaactcggaatgcatttgataagaaagcaacccccttcgaatacggcgccggacaaattcagcctaaccttgcaattgaccctggactcgtttacgatttacgcaccaccgattacttgaacttcttatgtgcttctggttacaacaatgctttactcaagttgtttgccaatttgaaattcctttacagttgttccaagtcttacagaattgaagatttcaactatccttcaattacggtgcatcatcctgggtcaaagactattaatgttactcgtacagttacaaatgtagggcttccaagcacgtatgttgtgaatactcactggccgaaggggattaaggttcttgtgcaaccaagttcgttgactttatttgggaatttgtcttggacagatggcaggcacagagtaaccagtcctgttgtagtgctgtaatgtaaccttagaagttagaagttgctctcagcattgttatgttatcactgtcatttgagtgtgtttgcgttttctgtttttaggctgtaatataagcgtgtttcctactcctgttgtatgaaactttttctaaactaataggtaggttaaaaattttgaggtattgaactttgttgcattggagctatgtttgtaatgggcacactctatcatgtatggaacctgtatctttgaaagtctaataggcattgttgagagttgagacccatatctaaataatattgaacaattttaattaggctccaatctatcaatttgccttcaccatttatttctcttctttctattttatctcgtgcagtcatgcattcatcttcagttactttggttccgaacatagaatacctctagattagtggctgaggccacgataacctgagccttggggctgcaggatccgagcaaggcaagcgaaaaatggctatcttggtgacaccaatgcatatattcaggatttgtgaccgcagagtctccagatccaatagtgaatggaagacagggagtggtttatgtaacatctccttccagcttgttggctttcaggatgtgcataagttgtgccatgtcggataaatggctgctgaaagtttgattggcaggttggtgcaaggttgaactcaatgatgttagacttagaggagcctataggctatgtagcatcgataccgatacggcgttttcgatacgttctcgatatggaacttcgatacgtttttcaaaaattctaatatttcgatacgttcccgatacgtcttaatattaaatattattttatatatatagtgtatttcatattaataaaatataataaaaggaaattgatagcaataagtaagcccttctccttcttacaaaattgataaaaatatggtaatggtaattgcaaaaagggattctatatttttattcatacaaaattgataaatatcttaaccaatgtgtggacatggagtgctactaataaaaaatgatttatgtttgacttcattctattatgttaacaaaacaaaacataatcatatttaacataatgtaaaatgatttaatatttgcttttaaatagaaagaaaaaataatgtaaaataacttgaggagaatgtaaatgatgtaaattaacaaaacataatcatatttaaaaatattaatatttgcttttaaattgctaaaaacagatatgttaaaataacaaacaatttgagggctgagaaaaaaaaactactaaaataaaatgatttgaacagggagagagttacaaattgaatggtaatataaatgatgtaaattataagcagctgtggtaattagaaattaatgaggtaaaataaaatgaagcagctagagactatagtgaatgaggaaaaaaatgaggtaaaaaaattcacaagcttcacttgctgttatgggcttacggtgaaggaggaagagcagctacagcacggcagaggagcagcgtggcggaggagtcgcgtgtcggaggagcagcgcggcggcagcggacacggtgaagagtggattgaagagcagtgcggcggcagcaaacgcggaagacagctatggcgggagcggcggaggagcacaaaatggacgaacaaaaaaaaatcgaagaggtaagctatgtagcacaaatcgaagcatagcaccaattttgggatttttttatttacaaaaataccccttctccttttgatacgtaaaatcccgtttttcttgcgaacccgtatcggtcgggtgtccgatactttgagaaaactttttttgccgtatccgtgctacatagcctataggcattgttagttgtggtagaagaggtggttcgagaggccatgtgggtcggaaaaaaaaaaagaaaaaaaaaggttgattaagatatgctctaatacaatatagaattaccatataagctctggttgttgtgaacaataatatacaaatatttacttattttaaacatttcaccatatgttttatttatcttgtctctttctatcatatcataaatcatataatacctatacttttcttctttttttttttctctctgagtttcttgtagcataatggatgtccaagaaagatttttcttagttttattgatttgcaaaggttatcagggatatgtatttataacagtacagcagagagtttgttacaactaaataaataaagactaaagagatttgaatttaaacaagtcctcacataattaatcatattttatcagcagaatttgaattacaaaatgataatagcaagcatttgaatatcagttggagcagctggaatatgttagtactcctacatagatgactgcatagagatctcatatgactaaaccattcaaaagagcattttcaggtgccaataggatttaaactcgaactagatggcggttatttcctaattttgagatcgtgaatcctatcttcctaatcaccaaattctgtgataatatcaatacaagaaactcttagtataatgttagccaaaagtggacgctaaatcacgaaagctgacataaaattgattagtgcagacttcattttttaccttacaccttattagaatgaatctgtcttcttttaggcacgaattgttctttttataaaccagaaaaaaataataaatatataaaatgactttcccaattaatttctcaacatcaaaataaaataaataaataaaattcaagtgagaaatcgggtttgagaggtcaagttctctaagtgaacagtaatggtgctagaagtacgtataaataatctgaaggggtattatttacgtaattattttttattttgtattatttgagtaaaaaaaattgactgaatgatttcttatttattgatggtacacaaatctttatttatctgcaaaagaatttttatttacataaatatatttgttaacattttacatgaatgttttttttcttcaatttgtatttataaaaattaaaaaatgtcacttttttcttttttaaaagaataataaacataatgtataactataatttacaagtggggaccaaaactgtttttatttatnnnnnnnnnnnnnnnnnnnnnnnnnnnnggcttgttttaaaagatttttaaaacaaattaatttttactttagttattaatttaacatttttttactttaaacctataaaaaatactactaagagtttggattaattgttacgaggtatttcaatttagcatatgattttgagaaaaaaactttattgtctataaactataacaattttatctgtcacaacatgattgcatttgatagaacataccaatggtgtggataaaaaaaatgtcatattttgtagcagtgttgctagtaatatctttaacagtcttatatttatcaaacattttctgacaattttctaaacaatataaaagactattgattaaattgaaataattttatactagttagtggttaagctacaccctcaacaatatttttatgatttcaaaatatacaagatataaaaattaaattagtaatcaaattaaaaaacatctttcaaaacaaagtgataaaatctgaactatcaaattaatctaatagtttaaaataagattaagaatctttttagatacaagttagtggtttggagaatttttttattaaaagtatataataagttctgaaaaatacttttattataaaataattctaaatttcccaataaatccaatccgtattttctgaggccacgctaggtacgtactttcacattaaacaggagcagttttttctgctatttcattagactactagttctgatcgaggatccatcatcttctgctattccataatcacccaatagctcaaatatgatgttctctaagctttcattaattcgtctaattctctgttcactcttaagcctccactcctcccaacttttcaagtttacttcttttgcctttgctgccatcactgctgaaaaccatgagagggaagcagctgctctacttgagtggagagtgagtcttgacaaccaaagccaagcttctttgtcatcatggtccagtgctgcaagtccttgcacgtggaaaggaatcgtttgtgacgaatccaactatgtgaccgctataaatgtggcaaatcttgggctaaaaggtactcttcacagtctcaaattttcatcttttcccaagctgctaactctggatattagtaacaacagtttaaatggaattattcctcagcaaatttctaacttgtctagagtttctcagttgaaaatggatgctaatctttttcatggttcgatccccgtttccgtgatgaagttggccagcttgtctttgctagacttaacaggcaataaactttctggtaccattccatcaattagaaacttgacaaatttagaacaccttaggctcgcaaacaatagtctctctggtcccatcccaccctacataggagagttggtgaatttgaaagttcttgattttgaaagtaatagaatttcaggatcaattccttcaaatattggaaacttgacaaagctcggcatggtatacttagccgataacatgatctctggatccgttcccacctccattggaaacttgatcaatctagagtcgctggacctgtctaggaatactgtttccggagttattccttcttcccttggaaatttgacaaagctcaattttttgctagtgtttaataacaaacttcatggtacattaccaccagcactgaataactttaccaaactccaaagcttacaactatctacaaatcgtttcaccggtcctttgccacaacaaatttgcatagatgggtcactgagaaaatttgctgctaatggtaattctttcaccggtccagttccaaaaagcctgaaaaattgctccagtcttaccagagtaaacctatcaggaaatcgcttgagcggaaatatctcagatgcttttggtgtgtatccagagttatacttcgttgagctgagtagcaataatttttatggccacatttcaccagactgggcaaggtgtcctagtctcacaagccttaggatatccaacaacaatttatctggtggtataccgccagaactaggctgggcacccatgttagaggaacttgtcttgtcttcaaatcatctaacaggaaaaattccaaaagaacttgggaacttgacctctttgtttgatctatcaataggcgacaatgaactttttgggaacattcctaccgaaataggtgctttgtccctcctcgaaaatttggagcttgcagcaaataatttaggtggcccaattccaaaacaggtgggatctttactcaaattagttcacttgaacttgagcaacaacaaattcacagaaagcattccttcgtttaaccaattgcaatctcttcaagatcttgaccttagtaggaatttgttcaatggaaaagtaccagcagaacttgcaactttgcaaagattggaaaccctaaacctctcacacaacaatctctctggagccattcctgattttaagaatagcttggcaaatgttgacatatctaacaaccaattggagggttcaattcctaacattcccgcctttcttaatgcttcatttgatgcattgaaaaataataaaggcttgtgtggaaatgcctccggtttggtgccttgccaccccctacctcatgataaaatgaaaagaaatgtcatcatgctggcattactcctttctttcggcgctctatttctattattattggtggttggaatttcattgtgtatttattatcaaagagcaacaaaggccaaacaggaggaggctaaagaagaacaaaccaaggattatttttccatttggagttatgatggaaaattagtgtatgaaagtatcattgaagccacagaggggtttgatgacaaatatctcattggagaaagtgggtctgcatctgtttataaggcaaatttatccacaggacaaattgttgctgtgaaaaaactacatgctgtacccaacgaggaaacactcaacctaagagcttttacaagtgaggttcaagcctcggcagaaatcaagcatcgtaacattgtgaagttaattggatattgtttacatcctcacttctcctttttggtttatgagttcctagagggaggtagcttggataaagtactaaacaatgatacgcaggcaacactctttgattgggaaaggagggtgaaggttgttaaaggtgtggcaagtgctttgtaccatatgcatcatggttgctttccttctattgttcatcgtgacatatcaagcaagaatgttcttatagatttggattatgaagcccgagtctctgactttggaacagctaaaattctgaagcccgattcacaaaatttaacctcgtttgcaggcacctatgggtatgctgcaccaggttaggtcctttttgttattaagaaatcaaaactatacttgtttcaataataagtgctgccacttgttatatgatactattttcatatttaatttgatatattacagagcttgcttatactatggaagtgaacgagaaatgtgatgtcttcagtttcggagttctttgtttggaaataatgatggggaagcatccaggagatctcatttcttcattttttacatccactggaacgtcatcagcttctactttgctgttaaaggatgtgttggaccaacgaatacctcaaccagtgaagccagttgacaaggaggtgatcttgatagcaaaaataacatttgcttgcttaagtgaaagtccacgttttcgcccaagcatggaacaagtgtataacgagtttgtgatgccaacatcatcttcagtgaatttattctccatggtcacacttggtcaactcgtagataattgaaccttcttgtttcctgcctgttgtaagcttttttattgctttaactagtgaacaatctcagcacggtttaccgtagactgaatgtagatcagtaatgatcaaaacagaataacatctgtgtgaccgtgtctcacattctctttattcctcaactcactgtgttgttgttatacatactgtttcttgatttctatatgctgtaatcgtgttagaatcatataaattgcattagatttacattggctatactctccacatctcaattacacaattacataatctatttgtgtctataagttttcaagaaaataattttgggactgatttttagaaattcagttctccctttctttggattctttaccatttgtctaataacatatattctaattcatatagtcttcaaaatatccatatacgagctttcttgcggatatatttagccctagtcctaaaaaatatttacttgaagagttttccgtttgtaaaagagttcaaccttgttattccgttagttctgtaaccattgtaatcgattattgcttcaattaatcaattaaactatccaacaaaacatcttggttcacattcagatcaatgtaatcaattaatatgacaagtaatcaattattactaaactagtattttaaaactagtatccaagcaaacagggtcggccctggggtagggccaacagggcgttcgcccaggacccaaaattttttgtactgatagtttaagtaaaatttatttttttaaaaaaaataaaacttatgttaggggttcattttatgtgttaggggcccattttttctatctcttaattttaatattatttgtatttcaaaaaaattgtgtgtcagggacccatttttttcatcccttagttttaatattatttatatttcaaaaaatttatgtattaggggcctattttttgtatgttagatgtccattttttttcatcccttaattttaatattatttgtatttcaaaaaatttgtgtattaaaggcccattttttccatttcttagttttaatattatttgtattttaaaaaatttatgtattagggacccatttttttcacttcgtcctgggccaaagaattttcaggaacggcccgggaagcaaagcaaccaattatgttaaatggtaattgattattgacgaatctactgctttttacaaaaactggttacagaggtatgtaacataatagttttgctggtacaagaagtttctatgaaataagaaccgtgagaggtatttcattcatacagcagcaaaatgttatgtttctgatccatatattgactgacaaaatagcacagcagatttctactacctaacctaacaggttaatgagccacctgtccaacataaatacaaagcttaagacactccaaaaggtataggtggttgttctttagtctgaaaatacattaattactgcataaaatattaatagttttcaaccatcaaattaacaagattctttgatttaatgattcatgcattgaaaaaacttatttaatgctagcagataccatgtagaaattgggactaatatgccaagtagttagcactttgtttcttgagagaggaatgaactagcaaaattctaaaatgttagataccctgtcgacaaattttgtggcagaatgtccaaaaatacatcatgcatatatattgcggtccgcactatacaatttgacgaatttgtacatttaaatttcacgtgaaactttggccccttcgacgctggttgtttctggattcagggaaacatatatatataatcatgcattgtaacatcaaattatttacgttgttgcctgagttagaaatggaatgtatatggggtcaaggggatgatatatatatataaggattaacttaatatttttgtttgattctcattagaattttcagattagtgaataattatatttattaattaatattatatttattattatatttgttctaatttatgtttatttttttatttttataagtattataatattatatttacaatgattaaaaaagggagaaaaatgaatattaaattatattttggataaataatcactttcatttattaaaatttaaaatattgacaaattcttccctaaatataacatataatctcattcattaacgataacagatggaaattaatatattaataaatttataacattttttcactttcagaaattaaaattaaaattttcattttttataaacaaatttactctacacattcaaaaataaaaataattatttattctaataataataataaaagtatcaagtttgagacgaagggaagaaaagcacatactgcctttgtctcgtttccaaacacacttttccttactttattctgagtttcctttattgctaggcaactttttttatagtgataatgcacttttcttaaagtgaagaaagataatttattttaaattaatcattagcatctcaacatatcatttagattataaaatatgtcaactgtttttataatttattttttttctttttcattcttgtaaaaaaatgattttttataaaatatttttttcttaaaaacgttttaaataatatttttttattgttcaaaatatttattttattgttcgaattacaatctaaatcattttaaagatgaaaaataaaataaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaccattataaaaatgaaaaaataactaaattataaataccaaacaagtatttaagcctatgattttttttcataataaactgagagggacatacgtagaaaaccctgaacaagaataaagggctaaggcttgacaatgtaaggtcttggaagaatttttttttattcatctccaatttataaagaaagggataatttctacccttttgcttgtttctttttcttttcatataattcttgatctttctaactaagggttgatagactcgcacaactagattgtaatgtaattgaattttactcctaattcatgttaaaatttgtcatttagttattaaatatccactatcttctcttcagcaatacaattttaaatattcactgcaaatatatagtgttcctagtaaatttaagaataaatatagttattttaaatagaagtatatatgaaaaaataattaataagacttttaaagcatcaacaatgttaaaataaaaaaggtaaaataacaatagttatgaaatggagaaaaataatttattgttcataaagctatatgtacataacacccacaaaacttttaaaaattgatgttcttataagcatatgctactttaagaatatttaccaagaacttgttccaataagcatttcttaggatgtgcttaatagaagaagaaaagaatatataagtgaagtgtttgataaaataagtgagaaatacgataaaaataaaagtatttgattttagagaaataaaaaaaataactattcatttattttatttatcttttttttttgttactaatcaatattatgttgattttttcctttttatttctttgaacaagttacttttttttttcttctaactatttctttctgttccttttttaagtttcaccacatcagccacctcggatccgatagacttggaggtgctttaatagatggctgttgccctgtttcgctttttacggagcctaatctttttccaccaaaaaaagaaaaagtcttattcccccacgtacatgaacaaagtggctaaaacatgcagcattttggcaaaaaattaaaaataatacaattaaataaaaaaatttgagaaatggtgcaagctagaaaatatttggtaaaatggtacaaccattcacgtccaaaataggtgtgttataacacgcccaaatggggcgttttcttgcagatggcgccatgtggcagtgtccgagtgtagcgtggttttttttcgtaaattttggaaggtcataactattgactggggcatccgattgaggcgaaaccggtggccacgcgatcgttgtttcgaggagaagcccttggcaagttcctaaaggagacttgcataaaatttttccccaaaagaggcctctaagtgcctcaaaattgcgatttaattgtcgaagctacaaaaaatttcgtgtttgctaattttttatttattcaattagtgaattgcaatctattctttgtttatctaattacttctcttaatttcgagcgttctgacataaaatacgtcatcatcggacattgctacgagaaattacgacagttcaaagttatatgcatcgtcaattttacagtataattttggattatttatttatagtgtagaattgacaatgcatataactttgaacagtcgtaatttctcgtagcaatgtccgatgatgacgtattttatgtcagaacgctcgaaattaagagaagtaattagataaacaaagaatagattgcaattcactaattgaataaataaaaaattagcaaacacgaaattttttgtagcttcaacgattaaatcgcaattttgaggcacttagaggcctcttttgtgaaaaaaattttgggcaagtcccatttaggaacttgccaagggcttctcctcgaaacaacgatcgcgtggccaccagtttcgcctcaatcggatgccccagtcaatagttatgaccttccaaaatttacgaaaaaatcgggctacacctggacactgccacatggcgccatctgcaagaaaacgccccatttggacgtgttgtaacacgcctattttgggcgtgaatggttgcaccattttgccaaatattttctaacttgtaccatttctcaaatttttttatttaattgtattatttttaattttttgcccagcattttcattatccgagtgaatatggaagagaaacttagagcatatttaattattttttatttataagaatttgttaaataaattatttctataaaatacttaaatttaaatttaaaaaatctacaatattaattggattttctctaactacaaaaaataagaaattattttttatcttaaaaaattcatcaaacatcttatattgaaaatcaacttagcaaaattcctcttttttgaacggtgatgtggccatagtcaattagtcattgacttatgattatctttggaataactttatcttttctctccttaaaaacagagacaatacataaattggctgtgaatgtgattggagggttttgttacgtaatgggggtattttatttttttaattaccgtttgagggtagttttcaaattaattattaaaaaggggtaagtcgtaacatctgttacgacttctcagtcggaattttatttttttttaattttttaatttgaagtcgtaaaaatttttacgacttcaatgtaatttttttttatcctaagagtaaaattttttacacagaagtcgaaaatatatttacgacttagaagtcggaaaaatatttacgacttagaagtcgtaaatatatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattatgtaacttacccattgctgagaaagttatttacttccccatgttagatactcctcctctttctattgttacaaactaatgccaatgcattgtttggcttatgcagaaagacagtatttatatttggtagaaagataatatttacgtagaaattgaaaataacgtaaaaaaatgataggaagagctgtaagcaggatcttttatcaaaattgtcggtggtgctgttgcaatttgcaataagtaataaataataacagaggtaggcattgaagatgtcactgctggtgtctatgtaaagaaaataggtgaaagttacgtaagatacagagctagacttaccctatgtttggaagaggaaaaaataaaagagaggaaagaaaacttcaaaatttaaattggagaaaaaattaaaaatagaaaagttgtaatttttttttctaaaagtgagttactatctttgatttttttttttctcaaaccaaataagagaaatatatagttatacatgtttttctttcttttaattttcttttcttttatttgtgttccttccaagcgggcccttatagagtgaaagacttttttttctgagtgacatatggtgattggtcagtggtggaagatggcgtaggcaaatttcgaaagccaataatagtaaagctttatgcgcaaagacctacataaaattttataatatatatacattctttgggtcttacttttttatttttattgcatcacattatttactatatttttcaactttatttgataggatgatatatttatcaataagtaagtatatatacctttcgtaaataattcgtttttaatattaaaataatgcttctagagaatggtgaaagcagagttatattagggagcaatgataactgcatactcttttttttagatgcgtgtatggataaaaataataatcactatccacaccatttttaatcaaagttaattaaaagtaaataataaataaattcaataataaataaaaaaattaacaaattaaaagatgaaagaaaagaaaaataatagaaaaaataattataaaaaaatcatttataatataaagataacaatgaagagaatgatagatatactaaataatatataataactaatgaacaatgaagagaaaaagaaaagaatagaataaaattaagatggaatatatataagcagtggcacaggcatggattacatccacaccgaaacaacaactgaagatatattatggcattctccatcttcaaacatgttctgtcattattccttctctgcattttcttgcaggaacctaccaatgcccttagaaaggctagtaagcttttgccttttagttcccccgttacggttttcaataaagaatctgatggagttttgccatcatctcttcaagttccaactttgagaatttccaaatttatattttgttaattaatgtaccatgaaacatttcaccaattgtgtgctttgaattctgtgttttcagacctacattgtgtacatgggaggacattctcatggtccagaccctttgccaagtgatcttgaaacagcctcaaactcccatcatgatttactcgcttcttacttaggaaggtaacacagatgttaaattctcttaaatattatcaggacgtgcgtgttaattaaaatttgataatttaacagtcatgagaaggccaaggaagcaattatgtactcgtacaataagcacatcaatggctttgctgccctacttgaagaggaagaagcatcacagattgcaagtgagcaaacttcactaccatatattgccatgatttgcttgtcatcttgacgccacacgaattgatataataatgtattatatgtttctattggtacagaaaatccaaaagtagtttctattttcttgagcaaagagcacaaattgttcactaccaggtcatgggattttcttggactggaaaaaaatggaaaaattcctgcaaactccgcttggaggaaagcaagatttggagaaaatataatcatcgctaacattgatacaggtatgcttaattaatctctttttgactacagttcatcgtgctcttaattcagtttacattattttcttcttcatgaatttgtactgcaaacatattttccttttgtaaatacgttagttgcttcttgaacaggggtttggcccgaacacccgagtttccgcgacaaaggatacgggcctgtcccttcaaagtggcgagggaaaggtgtctgtgagatcgacagttttaatggtacaaagagttatctatgcaacaggtaatctttctgttatttcaattcaaaaattgggttgagcgtgaaataatatatgtattttaaaacgttgtgattatcacaccaatggaaggtagttattattttatttacagcttaattaatgttttatctgtatagttttggttcttatttcttcagttcatttattttaaataaattcacaattttaatttaatacttaattttgcacatttttttttgttttaattaattaaattatcttttagtaattaagtgttcaattttcaatcctaaatgttagttaaaatgtaaaaaaagtatgcaaaatcaggattaaattaaaattgtgaatttggtaaaataagaaaactaatatcatgaaaaaatagagagatgatctataggcgattaaaattataatttagctattctattatatgatgtattttgtgcttatgaaggatgggtttgaaacgaaagaaaaactaccaaagtatactagatggatagaaatataggcgtaattaactattattctatatatgtattttttttttaattttagattataaaggaataaaaatataatcatgatgaatattcaggaagttgataggagcaagaatatttctaaaaaatcgggaggccgaagttgcgaagattgacccaaggctacgcagtggacgtgacttcgtagggcacggtacccacacactgtcaactgctggtggtaattttgttcgcggtgcaaatgttgaaggtaacggcaatggtactgctaagggaggctccccaagagcacgcgttgttgcctataaagcgtgctggcaaaaattggatgtaggagggtgccatgaagcagacatgctacaagcatttgatcatgccatttatgatggcgttgacgtcatctctgcctccgtgggttattctaatccctatgccgaagctttgttaacagatgcgatttccgtagggtcactccatgcagtcgccaaaaacatagtggttgtttgctctgctggaaatgatggaccatcgcctttaagtgtcgcaaatgtggcaccctggtccttcaccgttgctgctagcacaatcgacagggattttatcagcaaaatttctctcagcaacaatcaatccattacggtaagagatctaatctagagattgatttatttcatatttttattatgtcaacttaattggaacctacttgtatcagggtgccagtcttaatcgtggtttgtcaccatcatcgccgtcacaaaagttctattcggtgattaattctgttgacgctaaacttcctactgtgtctacggatgatgcgtaagcacagttttatttattatttcccaagcttgctcaaatatttatatatgtatacttgtcttatatgttcgtgtgtatatatgtatgtatcttggtgtagccgtctttgcaaaccgggaacacttgatcctagaaaagtaaggggaaagatactaatctgccttcgaggcaataaattaacttcagctaaagaggttcaacagggtcatcttgctggcgctgtgtcagtttttgtgcaaaatgatgaggggagtggaaatttacttctggccgaggatcatattttaccagctgcaagtgtcggtggaaaaaccaatcatattttaaaaggacatactaacggcggcaataacaagtaaagttgatatactaatccctttaaaacgtcgtattctagatctctctctctctctctctatatatatatatacaccacacacacacatatacttgcagcaaagcaagtgaagcacttgaatattaatttttatatgtgttgttgcagggagattttagcttacttgaatgctgcagaaacacatataggagtaaagccagctccaatcatagctggattctcatccaggggtcccagttccgtgcaaccattgatactaaaggtccataataatatatacattttgttaactacacaccacatgaccagatgattaacttttcattcttacaattaatgacttatgtagagataaatttaagataattggtttcttttttcagcctgacataacagctcctggtgtgagcataattgctgctttttcacaagccgcgggtccgactaatcttgcaacagatagacgtcgagttcttttcaccgtgcaacagggtacttctatgtcttgtcctcatgttgctggcattgcgggtcttctcaaaacatatcatcctaattggagtccagcagcaatcaaatctgctattatgactacaggtacgttcattaccaaagtaatatccatataaaatcttcatgcacaccaaatcattggcgacttattaacaacgtactatgctttttattaattccagctacaacactagataacaccaatcaaccgattcggaatgcatttgataagaaagcaactcccttcgaatacggcgccggacacattcagcctaaccttgcaattcaccctggacttgtttatgatttaagcacaaccgattacttaaacttcctatgtgcttctggttacaaccaagctttactcaagttttttgccaatttgaaattcccttacagttgtcccaagtcttacagaattgaagatttcaactatccttcaattacggtgcatcatcctggctcaaagactatcaatgttactcgtacagttacaaatgttgggcctccaagcacgtatgttgtgaatactcactggccgaaggggattaaggttcttgtgcaaccaagttcgttgacttttaagaaaactggagaaaaaaagaagtttcaggttattcttcaggccattggtgtgcctggtcacaacattcctttatttgggaatttgtcttggacagatggcaagcacagagtaactagtccaatcgtagtgctggacacttagaaattactttcaccattgttatgttatcattgtcattttagtttgtttgcttttgttgttttttaggctgtagtataagcgtgttttctgctcatgttgcattgaagtactttgtcacaaaaaataaaaggcacaatcaacaaattaggacttcgggatgcgttgattaaaggttaagattgttgtgcctgcatgtaatttggcatatatatttaagattgttgtttccttttccttttgtgaaaaccagattaaactttcattatttaactaccttttctaatcgatcttagcaacttgttcttttccttggtttctcataaatcaaacacggagtcatggtgatatttacttgactttggagattcacttgatccaaaatccaagtcattggtggctataattttgtaaatttaattaataggtcaagttgtaattttagtttcttagtttttttttaattgtaacatttgattcttaattttttaaattgataattttggtatcctgctagattattaataattaattatgattgatagagtttttaaattaattaaaaaatcattaactattaaaaactttaataaaagaattattaattctaatcctttactgcactccactcctcctctcatatgtaaacaactctttcattgccatcgcttcacaccacactactagaaaaatgtgttttaacatcgctaagttaacatcgattttattaaaaatcgatgttagccaaaacgcggtggcaaattcgtaaataagcggacttcgttaacatcggttttcttaaaaatcttcaaaaccgatgttaacagaacaccttaacatcgatttttaaggttattttgaaaaatcgatgttaacagatagacggtaacatcggtttttaaggttattttggaaaccgatgttaacagatagacaataacatcgatttttaaggttattttgaaaaatcgatgttaacaaatatacagtaacatcggtttttaaggttattttggaaaattgatgttaacagatgacgttaacatcggttttctttgaaaaccgatgttgttaaggagatagtcaacattggtttttctttgaaaaccgacgtggttattgtcactataaaagtgctggcccccaaaattaaaacccttcactctggtgccttcactactgtcgcgttttgtcagcattcactgatcttgttccccactgctcgtgttcttcactcccattgtcacttagacggtggtcttggcgcttccaatctcgctcttggtctgcttgcaactcacattttactttcactctcactcgcgctcaggtactctcgcaactcacattttgaattcactggttactattcactgtttatgttaccaccatggatttccaaagtaggaggcttcatttgctcgagaccgtgtggttgccatcgttggtgttagcttcacaggtacttgactttatttcatgcttattggtgttgcttattcatgtctatgagacaatggctatctactgatgtatttttgataaaaaaaatgtcggatagttgtatggtcatttgctagaattggttttattgggtgataattgtatgtggtagggtactatgtggttttaagatgaaatgttgaataggtcagatgtacatctgtagcatgactggatctgtatgcctttgttggaatgatgagaactaataatggtcagccaagcaaatgagcataggacctggatattttcaataggagaaacaagaaagaaaaaacaaaaacagaatacatgttggctggcttgttttggtttctgttttgacttgtgggatacaaaaatagtggggatagttatagccttatagatgtttaatttattgatgttgttattatactaaattaagtttctatgggttgattttttgggaaaacttagcaactgatagtgcaagttccatttttcctatatatacagtccccaattatcaagatgagattatttatctcatagtttagtgccaccaagctgagtagtgagaacaaaatactacttaatttaagttaagtaatagtcacatgttgtatattatagaatgctttgatgaacactaaggattaaggaatactaattattggctgggaaaaaatgacttctgataaacatgtgaaagttgactcttatgcctcaaactattgtctaaagtagtgattaaagaaactcttagattacatcctgtagcgtttgcatcacatttgggtgcctcaatagttctgtcatagcccactctagggctccaagggtagtatcacttcctgcaacaaacatatcctgaattgaaagaaacaaaaatcaattggtaatatatgtcattatcaccatagttttgtaacttcaattaatgaaaaatgaaaatgaaagtaagaatagccgttacacttaatctcaagcacttttattagtatggaccttcaccttgagatttatcacactacttgcctgttatttttcatttctccttggttcaaaaagtttttcaatttgtcaaatttcacctgcaaatttcattgatagttgaggtatgatgagggaaaactagtggatgagatgatttctgaatacaagaatgggagcctattgagaaggaaattaagaatagttttagctaagtattttgttttgtgtagcagtttcatttgaacatctgaagacattgctgctgggaatagtagttcaagcttgtggtcatgtgcaggctacttacttaaaactagttattacttcccttcatcagtgtccccaaagaaaggtggctggtccttgtcaagacaccaatgaatttgtaaagtgtaaactagatgtatattaacaatacatcgtttccaaagaattactcattttttaatttctccttaattgtctgatgctttcatttatgcaagcaccaaatgctagagattatgactgagtttacatcacttgaatattttaaattgatttctgtgtttgataaggccttggcatatattatgtaggtcattgataaagtggtacctgcattagttgaccttgcaggaataacaactaagtgagcctgcaaccccagttacaccgccaccatcagtagaacacaagccacagccagcctctactccttcaccaaaggtaagccttgtgttaaagttaaatgtaaaccaaataaatatggtctcactattaaatatagtctaatgttctatgttcattgtaggttgtaggagagcaacaccgttttcccatttgccttgtcttcacgaccttcattgttggacatttcacacagatcatcatcacaggtacgaatatgtttcatatttttgttgtacaatttggcttatgactggttttgaaatattttgtatgtcaagtatgcatcttgccttttctatacaattaatgttcattatgagtgaaccttagtttctcgtttgagattcattacaatgattcttccggacagtttggattaatcattgtattgattcttgaattgtccatttggacagtttgggaagacttattttttatagtatattcatatgtatatgttgagtttgttttcttaaatttgatgaaattttggtacaatgtatttcactttgttctccgggtgcatacttgattgtggtggaactcatgtcaccgctttcatgtcgtgtacttggagactaaagcgaaatgttgccaaaatttcgtcaaatttaagataagagactcaacctatacatatgactatactatgaaaataagtctttctgaatgggatagggccacaccttcaatgaaaaaagtgaggttttcatgcatggaataactttgtgagcatcacagagttattaattagatggatcgaagttggatgaatgcaagtcgcatcacggttgagtatgaggaaggcgttgaacatttcttgcaatttgccttggaaagaagtcgaccggatggggatgaaaaatatttatgtccttgtatcaattgtttgaatggaagactccaaacactggacgacatacgatagcatcttatctgcgatgggattaagaagacttataccacatgtatatggcatggtgaattgacagacacgcagagggtctcgcaaactgaaccggttgatgttgacatcggagatcgattggaggatatgattcgtgatctgggacatgattcttttcaacaagcacatgaccctatgtatgatacattggaaagtgattcgaagaagccgttgtatccggggtgcaaagagtctttgacactgttgccagcggtgttaaatctggttaatgtcaaggccagatatgggaggagtgacaaaagcttcagttgactgcttgaggtagttcaggacatgctttcagatgaaaacacgttgccaagaagttattatcaggccaagaagattctttgtccgatgggtatgaagtatcagaaaatttatacctgtcctaatgattgcatattgtacagaaatgaatttcaagaaatgcataaatgccctaggtgtggggtatcacgatataaactgaaggccgatgacgactgtagcattgatgaaaactcaaagaaaggccccccgcgaaggtgttgtggtatcttctgatcattccaaggtttaagcgtctgtttgctaatgaagatgacgcaaaagaccttacatggcatgcagatgggagaaactgtgatggaatgctctgccatccgccagattcctcgcagtggaaaaaggttgaccatttgtatccgaaattcggggaagaacctagaaatcttaggcttgcacttgtcagtgatggaatgaatccttacagcagtctaagtactcagcatagttcttggcctagtttgctagtcatttacaacctgtctccttggttgtgcatgaagcgaaaatatatgatgttgtctatgatgatatcgggaccaagatagctaggaaatgacattgatgtttatcttagtcccttgattgaagacttgacagacttgtgggatgagggggttgccgtgtttgatgggtatcataaggagacattcaagttgcatgcaatgctattttgtaccattaatgattttcctggggactgaaatttgagtggatacagtgttaaggaccatcgtgcatgccctatctatgagcaagacacgagttacttgtaacttaaacatggaagaaaaacagtttacactcgccatcgacgttttcttaaaccttatcacccttatcgccgattgaaaaaagcgttcaatggaagtcaagagcatgaaactgcaccgattccattaaccggtgaacaagtggttaagcggtttaaggacatccatactgtatttggaaggacccaaaagaagagcaaaggtaatacttgcatgtggaagaagaggtcgatattgtttgatcttccatactggtctgatctagatgttagacattgtatcgatgttatgcatgtggagaaaaatgtgtgacagtgtcatcggcacgttgcttaacattcaaggcaagacaaaggatggtttgaacactcgtcaagatcttgctgagatgggtatacgtgagaagttacatcctaggtctgatggtaagaaaatttacttgcctccagcatgtcacactttgtcaagaaatgaaaagataagtttctgtcatagtttgcatcgagtccaagtgccacaaggatactcttcaaatattaagagccttgtacaaatgaaaaatctgaaactagttggcttaaagtctcatgattgccacgtgttgatgcaacaactattagccgtggcaattcgagacattttgcctaacaaagtcaggcatgctataactcgcatgtgtttcttcttcaattccatttgtgtgaaagtcgtggaacctgtaaagttagaagacttggaagaagaggcggctattatcttgtgtcagttggagatgtattttcctcctttatttttcgacataatggttcacttgttcatctggtgagggaaattaaatcgtgtggtccagtttatttacggtggatgtacccgatcgagcgatacatgaagatcttgaaagggtatacaaaaaacctacactgtcctgaagcatccatagttgaaaggtacattgccgaagaagctgtcgaattttgttcagagtaccttgaaaaagcaaaacctattggtcttcccgagttgcgacataacgacagagtgggaggaaagggtacacgagggctgcatgttataacgccttctttgcaggaattgtaacaagctcatttgtatgtcctcaataacagtaatgaaggtcctgccatacatggttcgtcatcaagcactactgaaggaaagtaatccaagaatgacaaagaacaggctgttgaaagagcataacaagactttcctggaatggtttaaagatacaatattgagtgatgattatgcatctcaaactatgaggaaattagcagatgggccaaaaggaaatgtaagaagttggcaagggtatgatatcaataagtactcgttctacaccaaacaacaagatgacaagagcacaatacaaaacagtggggttagcttaagggctgagtcgcagcacttcgcaactgtgcacgaccacaatccatgtttggcttccatgccttactttggagtaattcatgacatctgggagcttaattatgtaactttcattatgtgtgttttcaagtgcaagtgggttgatatcaatatcagtgtgagaaccgatgactttggatttactttagtagatcttaacaagctcgtttatcaagatgaacctttcatcatggcagaacaagctaaacaagtattttatgttcaagatccatgtgatgaaaggtggtcagtggaactccatggaaaaaccattggtattaatctagacgatgatgattcaacccttgatgctggtgtcattcaattctcgacaccaatggttgacgtcaacagaaaagatgttcttggcgatgttcatgcaaatcgtaatgatcatgatgaaggataattaattaacatcacttaatgtaattttcttgataacttttttcgacatttcattttaataggtaaccttacttgtcagttaactttacttacgtttttttttttttgtttttaacatgatcatgactacaccaccgacctcctctcctcctcttgaatcagcacatcctttgcctgagtcagcacctcctcgtcctgaggcaccacctcctcctcctcagtcaccagcacctcctacggggaagaagactaggaaagcaacacggttgcgttcactggctaccagacctcctggtgctgacagaccagtggttcatgttgaccctaggactgggatgtctgatggtccccaggcgaagaaattgaagacacacctagggatcgttgctagaggcaaggcagatgtcaccattgccacctggaaggaagtttctgatgcgcagaaggagttgatgtgggaggacattcaggtattacaattaaatctccaatgtgattgcctataatgatacaatataaatgttattctaacagttaaacacacttcattataactcagattgaatttgatatacctgaagcgttcgaccaacagattaagaagaaaattctgcagatagtaggtgagcgatggaggcagttcaagttagacctgaccaggaaatgggtcttgggaaaggtctctaaagacgatgctgatgttgtctgcgagaaatatggcatcagttaggaaaaatgggcccaattctgtgagacacgtagagccgcttcctaggaggttagccgagttacaatgttttacaatttcacaactatgaagtcaaacaaacgcttttttttaccctatatgtgtaattcatacaggatgttagaaagaaggcccaggacatccagaaactaaccaccggccctcacgtgttgtctcgcgggggtacgacttgttagaaaagaggttgatggaaaaaaaaacaaaagaaacaattggaggaagctacccatcctgatagcacagagaccatcatccacccttcttcccccgtgagacggcacgtcaagtggaagctggctcgcacgaaaaggaccggggaaatgacttctcaggcggcacatgatattgctgagaggattgtaagtcaaacaacaatctcaatgacattctatatgaatttttgcatcacaaatgacaaaactaatgtacttactttcattgcaggattccctggatgagcaatcctcatagggtacttttgttgttagtggacgtcaggatgtcctgactgctgccattggacgaccagagcacccgggccgtgttcgcggtgctggagccggtgttaccatcacctattacttcggaccggctgcctcaacctctcgtaagtcaaagtcaatggcgcctaaagacttggatcgcctaaaagacaacatcagggtagagctggagcagtccatcgctaatcgacttacacagtccatcactgatcgacttacacagtccatcactagaaagttacgcaacaagtggtgatgagcttcagccaattgcagacccagatgcagtctcagggtgccatgccgcctccagaggttcagtcatgccctattggtgtccatgtcagcaccaagggaagctgtgtcgatccctcggggaatgacccagacacgggggcatctgacatgtatgagttgtatgtcgatgacaatcctcccagcctggttgcccttggcagagtttatgagggatcgacgatcgtgcacaacgtccctcttgccactgatcaggtaaaggtgagtgttgaggaagtatgcgatgcagatgctcgcgtccctgtacctactgacgaggttcagttagtggggcaaacccttaacactttccttgcttggccgacacatcttgttcagactatttcatcacagatatttcatttttgccttatttcttctcatttacaaatttgtctcatacaaagttaacctgatcgttcacttatggttcttaactgtgtagggaaaacaagaagccaagggaccggcgaaacctgtagataatctggaacatttttctgatcccttgtaccaaatcgcgttgaccatccccgatcttttcatcagacccttgcaggtgtcatgggacgcggacatgttcggtgtgcagaataacgacttccccttgtacatcaagcatgaggatatttcggagattatccatggtggtcaatgtctcaacatctccgttatacaattgtggcttctgtaagtgactttcaattgcctaccattattacttgttgaattgtctttatattcttgcataattgattttatttacacgctaaaataggcatatgaatgaattgagcatgcaatcagatcatgtcgatgtgtacggattcctcgagccacaatctatacagagatctggtcaatctcaatttcaaatcgaggactatatcaagaaatggatgcagagttcacataaagatgtctacgttgcactgtatttgaatgggcaagtataaatgagtatcgcaatttaattaatgtatgcagtatatataataacttgtttttcaaaatgcaatgcacattggcaactggccattatatgtcctaaggccaatgtagtcatctgattctgttcgctgcataacaggcctgataactaccttaaaggaattattaacaggtaggttgtaatttgtaacaatttatgttatttctatggcatgaatatgttaattgtatactatgcatgcatgtttctcttaagcagttctttgaagggagtccaagaccctccagcaaataaatcaaaggctactactaaatggattgcacttaaagtaagtcttctaataaatcatggtttatgtattgaaaataatttttattactatttaccctaattgccatttaactttgactatgttattcaatttagtgtaataagcaaaaaggaaacactgagtgtgactattatgtcatgcattggatgtggataatagtccaaggaggcttcacagataactaggagatgataattaattgtcttctacttaactaatatgttttgtgacttgtttttgttttgtgcttattcaattatttttctcatgtcatgcagtatttcactgatgaaagaccattggaagccgacaccttgaaggctattagggttcaatgggcaaagttttatcttaaagttagagatgacatattattatagattaggtggttcttggattttcaaaacaattgtataaacattaggttaggcaattttcttatgtacatatggacactattgaattttatttgttatttaattgaaataattaatatatttaaatgtattctggaattggctggatgtctgatttttaattcacaggttaaagaattgctaaaatttaaaaaataaacaaaatattaaaaaataaaattaatagaacaacatcgatttgaccaaaaccgatgttaacttatactacaacatcagttttttttacaaaaccgatgttgtcatgttacttaacattggtttcttcaggaaaccgatgttaatgttctaacattaacatattttacgtttttatttccagatagcgacattggttttaattgagaaaccgatgttgtgacgttaggttaacatcggttttggaaaccgatgttaacttccacactttcaacgtcgcctgattcaacatcgggtcaaaatcgatgtcgaatgtaaaaaataaccgatgttgaaagctgtttttctagtagtgccacttcactggtagtagcaacacattaggataattaatattttattaagtttttttaatgattaatagtttttatttaacttataattaacttaatagttggtggtaattttgtcatgatgcagacatccttgtagcatgtctgcatgtaatttgatttcactttaataattttagtctctaattttttaattcatgttggttttcctttttttaattataatatttgatttcctaattttataaattgataattttaataaccttaataatttattaattatgattaatagagttattatgttaagtataaattaattaaaattcattaactattaaaactttaataaaataatattttattaagttttttaatgattaatagtttatttaactcataattaatttaataattctattaattcggtgttagtactctgtcggagcttcttattgatgcaaacgatagtgacccatcaatggttatcaaggccgattgtgacgaatatgatggtgttcaaacgaatgctgattacaatggattatattaatgaaaaatacatgaaactggattgtgatcaaactgtgaacctattgttaacaccgaatctccatggacgtgagggtgcaccgcctatgtcaaacatatgggtcgagccaatctattgggagaagcaaacacatggctcgaaccatgataacaacattgttgcgattggtcaatgcacactgagcatgtgtcgtctgatcaagagactccatggcagtgcttgttggcttcgtgatagtggtccttgatagacccactccacgaaccagattttgataacttccctgctatgtgagcttagagaggtccctttacttgaggccgaagggttgctacgtcagccaggctcaccatacaatcttcattcgaggtcgaggagttcctgacacggtgtgcaaattaatgtctgaagttttaaccgagcaggagttagatggtgccgacgactttacaaacgcatgcgtgttgaggtgttgaagtgtattgctatgccgagatgattgagcgagcctcgtacgagatgtctgagtaagacttgtgacgaggtgtccgaatgaatattgtgctgacgtattcaattcgagccacgagggtgtgttggagcattcttttttggattattcatgtcggcatgtaggtgctattttggtttgaatgccagagtaaatagtggggaagacttcgacagtgttcagatatgcaaagccggatagtgcactttcgtatcattctttttggggtgtccttccttattgctcaaagaaactatcctccgaagggtggcgtacctacaaaaaaaacatttcgaccctcaagtctcgacacagagagaatagtgagaatagtaaatgaatggatagaataatgtgttacctttgagaacctaatcctttatatacacgtatttattagccatacctcttaattgaaggggcgtaatatggaattacctgatagtgttaatatatagtattaagacaatataagctaaattccttaacctcactgatagtgttaatatatagtattaaaacaatataagctaaattccttaacctcaatgatgtggttgctgagagggtactaggctatgctgaagggatttcaggttctggccgagagggtactatgtcatgccaaaggggtgcttaggtcatgccgaaagggtactaggccatgccaaaggagtcttaggttacgtcgaaggcgttctaggttgtggtcgagagggtactaggttgtataaaagctataaaagcttttttggtgaggaatgaattatggattgttgcagcgttgcaggtttgagaatgctgttgtggcagcagaaaagattggcctgttggattatagtaatgtcgaagttggtaggattgttattgttgtgaaaatagtgacataacttttcaattgcatgggcctaatccatcccactttgatgtcaaaataaaccttttagacaattgaggttaaaaaaagatatagagaaaatgaggcagtggatataaaaaggggaaggttgaacaacacattttagacaattgagttttgaaccttcaaagatgcaagtaagattttgtggccttagggatgttagagatttgaacaatccaaaaacctgttctactcattttggtaggaccgtaggaggaagggtcatgatttactgactataatatgtgcattttgcaggcaagagggtgtgggtccagtttgggaacagcttcatatcataaagaagttgttacaaattccttttctcagttagtgcttcaacttcatgattttgatgatccagagaaggttggaaaataacttccagatatatattccttatttatttatttattatgtgctttatgttgtgctaagcttttctaaactgtcaaatatttgcacaaataaagatcagagtgaagattcattctggttctttttctttatgtggagctctggctgctcaggccaagagagtccagtcaagctgggttatgctggacaagtaatggatataataataaatacttatttgaggatttgattcgtatcagaaattggttgagaccttcctcttagaagattgttgatactaaaaaacaataatcaatgtggttaaattgaaaaatgcctgattatataaatggaccattaaaatatctcttattttttagcttttacattttgcatttcataattttatgttaatcttaattgttacgaactcggcaagtataccgatcgttacaagtaataaagtgtaagtagagtatcgtctccacaagaattgaggcactaatttaatcacaacttgttatcttaaaattgaaatgacaaataatatgtttttaaagagaatatgattgtattttggaattgaaaaaatttaataactgaattaaaaattaataaaaatttaaaagcaatattaattaagagttacgcattgatgaggaagaattgtggtatgagcacattcacctttgatcctaccttttgtatttgaattggttactaatttcaattattctaattcctcagaggatgtatttttacataaattagttgaatcctaattctttagtaatttaacctttaacccaattagaaatcataattccttagtgatttcctattaagttaagcattaagctaatacatctattgctctgcaatcatacatttctatccctaggtaatgtaaaaactgtgttattttactgctttcaaaaattagaacttcgacattcctattgtaaaccttaacccttagaacctcattagaatgataaagtctaataaggaataattcattcaagaataaaataaaataaaacaattatcacaatttatattaatatcaatccaattatagagaagtttacattgattctgtctctaaccacagtaaagaaggttagctagacattctcatatctaaccttaagcacagaattagcatatacctagacaagaatttcaaagacaatagaagaagtatacatacttctcaatcttgatttaatcctgtcctgttggccttgattcctcctcctcgttctctcttgcatttttgtgtgttattttctatccaagagtcccccctttgttttctgcacatccatatttatatttagggtaactaagttcttatgctgttctattttttgtgacaaatcttttttggttctgcttctttccttcttttcctgatttctattaaacaaaatatgcataaaataagtaatggaccaagaattgatgaaacttaaacttatcgtaacttttgttgataaattataattaaattattaattattttaacttaaaactattatatgttagccgtatatcattaatttagcagatatatgagaattttaggatgaggacacaatataggaggcatttgattcgagatacttcgtgtggagttcgctttaatgacatggacgatattaatcatgtttttcatcagtgcctttttgccaaatctgtttgaaaatataataatgatgcttagttctttgctgcatgactttttcaagcagaattttgaggattggttggtcacacacttgcggtctgattgtgttgtttggtctatcttatttgtggttcttctggatattgcaagaatatgttgatctttgagaacgttacacaccatccattgagtattatgcacgcatcgtatattgaggcaagtagatgctattggtgttagcttgaaaaaaaatatagtgaatccccgttggcaatgttgtagctggtgtctaataatagtttgaaaaaaataattaatgttatttacctaataatttttcacacatatatattaatttttatcccttttcaatatattatttgaggtttcgtagttttacacaaactctccttctttttttaaatttatagtaatctccttataagaaaacataatctaatgtttttaaaacaattaaaaagagttagtgtaatgtatattagaatgtttataaatgtatattttttcaacaatcaaggtgatttgtataggagtagaaaaagtaagatgagtttgtgtaatttcaataaatcgctggataattagtgtgatttagactattatttattttatcacacaagtttctcttttatcttcatatgttttcctctcatctataaatttgatatacttttactcatcgtgttactaaggtgaaatattcattatactttattgataattaatctttattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagagagagagagagagaggtggacggaagtagaggagaaggggggcaagtgccccctccttaaatttgcccatgaaattagttatatgcccttcatttttattatttttttcaaaatatcataggtcttaaaatttgagagcagttttttaaatttccttttctcttctgtcattcgttttcaccttcacgctccaccggcccttgttacatttgcaacccttctcttctcgcgtccggcgacaacttcctccacggctgacgactccacggaccgtgcctgcgcctgcgactttgctcctcctccgtggctccgctccgcctctgctcacgggagtcacatctagtgcctagtagattgctcctcggctcctcgcgtgcgcttcctaagctcgggccttccacaattccacttccaggttcactttgtttattttttagttttccccaatcaaattttgattttgattttcctgaaaaactagtggttaactggttattgttattgttgtttttgattacatgttgctatatatggctaatgggtttgaacatgttgtgttatcaacaatcagcaattgaggctttttttatataaaaaaaacatatagcaattgagagatggtgctgttagcctgtcacagtgttagtgtgttactaattgatttggggttatgatattccattattccctaaaaatcaaaagtacaaacaaactgttttttggtgcctctattaatattgtgaattgtgatagactgataatcgagggcagaactttaggataaacaatttagacactttttttacaagtgaagtggtagtactaatatttgaaagtattgataataagacaattatgaagaaatttcaaaaaaataaggcctagaaggatgacattgtaattatttttctaaatatgtatttaaacttttgaatactccgttgatatatttttcatttcggtaatatactactttttttggtttaattctttataattttttaaaatggaccttgtaaaatttcatttttggttttagtctttattattttattttagtagttctaatgcactattttttattttatttcttataatatatatttattttaaattagtctctttgaaaaatatttaataagaattaaaagcaaataatctacatattacaaggaaaataaaagaaaataaatatattataaggattaaaataaaataaaaaagaataaacctaaaaaagtttgcaagaaacatttaaaaaataattttataaggaaaaaaatattataagaattaaaaatatatttaaatcatatatctgaaatgtttttcatttaaagggttttttctctctattcctatttttaaaaattcaaaatttcacttttttaaaaaaataaaataaaaacattggacgagttttaagcataacttaataaacactcccaaaaatatcgaccgtaagtgcgcttttgttcaatttgtagggtacacgtgctcggtctttcacatagtgaccatgatcaagcttttctgctatttcattataatcgtagttgtaaaatatggtgagataattactccgattgagacaaaggtttagtagattagtactctaattaatgagtgagtaattaatctaatttgatatgatatatatatatatatatattataaatttaaaattatatatatgtatctaatattatttgaataaaaaatatttattcatattttaaaatctaaaataataattgataataatctaaaattttaaaaaataacaaaaattataaaaccaattaggttggattagaaatcagtgcctaccaaactaagtttgactagatcattctagattaaccgtataatcagtctaatagtaaaattgatttaactagatcatcaggttatggtcaactagtcagaccgtactaaaaaaatgcgatcacccagacctttcaaatacttaatctaatacaaaaatcctgtatacgaaatttcttcagttgcttactcgacctaagcaagccagattataagctgctctctggaggcgcatagattggttgaaaggtttaaaagagaacattattttaggtttagggggactgattataactaatacattgattctataatttttttagaatttctttttccataagaactcttttacattgtcttttatataattactttttgctaaaatactattaattattttgcatgtatttaacaaaaaaaaaagtttaattgtacactaccactaaattataattatttcatgaattttcgatcaatttgaatttttcacatattttatcataacaattttcaattttgctcattttactgatctattattaaatgtgtaatgacattttgacatgtccttaaaaacaatttaaaatacaacgttgtttggtaacaaattaaacaactgtgattttacaaaaaaagataattagaaaatgacagttgttttgttttagtttctagttttttagggacacatttaaagaatctgtaaaataagcaaaatatatatatatatatatataatgataaaactcatgagaaaagcttagatgataaaaattgtaaaacaatgataattggaggattatgcctaataaatattcaatattatacattattaagatagtctctcttgcaagcatgagaaaagattattagtcacagtaagataaattatactccccgtgttctaaattaactgaagttttagcattgaaagaaaaaatcatagtggcttatgcttgctgttttgaattaaatatattaaataatctattccaattttaccttctaactaaatgacttgttagttattatacatttattgaaattaaaaaagagtataagaatattttaataaaattgtcccttaatatatattattgtctggaaatttatgtgtgaaaaacttttaaacattcttcattttggaacccagagagtatcagctaatattatactattttaaatacacttttgtattaataaaaaattattagaaatcataaaattttgagtcttacgttatatataggaaggcacgtggtagctttgagcgtccaacattttgtactttaccataatcacccaatagctcaaacatggttttcactaagctttcattaattcgtctaattctctgttcactcgtaagcctccattcctcccaagttttcacgttttcttcttttgcctttgctgccatcactgcttatgaaggttcggaagcaagtgctctacttgagtggagagctagccttgacaaccatagccaagcttctctgtcttcatggacaagtggtgtcagtccttgcaggtggaaaggaatcgtttgtaacgaatccaacgctgtgaccgctataaatgttacaaatcttgggctaagaggtactcttcacactctcaacttctcttcctttcccaagctgctaactctggatattagttacaacagttttagtggaactattcctcagcaaattgctaacttgtccagagtttctcagttgataatggatgataatctttttaatggctcaatccctatctccatgatgaagttggctagcttgtcattgctaaacttagcaagcaataatttttctggctacattcctaaggagattggacaattggggagcttgaagtatttattacttggatcaaataaactttctggtaccattcctccaacaattggaatgttggccaacctcgttgaacttaatctgtcaagtaactctatctctggcaaaattccttcaattagaaacttaacaaatttagaagcccttaagctctcagacaatattctttctggccccattccaccctacataggagacttggtcaatttgattaatttggaaatcgatcaaaataaaatttcaggatcaattccttccagtattggaaacttgacaaagctggactatatttctattggcgataacatgatttctggatcaattcctacctccatgggaaacttggtcaatctaaagatcttagacctttctgaaaacagtttttctggagttattccttccacctttggaaatttgacaaagctcacctattttctagtttttgataacaaatttagtggtagattaccacccggaatgaataactgcaccaatttcaaaagcttacaactatctaataacagtttcactggccctttgctgcaacaaatttgccttggtggttcacttaccagatttactgctgactataattatttcacgggtccagttccaaaaagcctgaaaaattgctctagtctttacagactcaggctagatgtaaaccagttgaccggaaatatatcagatgtttttggtgtatatccagagttggactacgttgatctgactagcaatcacttttatggccacatttcaccaaattggggaaagtgtcctcgtctcacaggacttgtgatgtccaacaacaatttatctggtggtatacccccagaactcggccaggcacccagcttacaagtactagtcttgtcttcaaatcatctaacaggaaaaattccagaagaacttatgaacttaaccactttgtcgacgttatcaataggcgacaatgaactttctggcaacattcctgcagaaataggagccttgtccggccttacaactctcgagcttgcagcaaataatttaggtggcccggttccaaaacaggtgggagagttgcgcaacttacttcacttgaacttgagcaagaatgaattcacagaaagcattccttcagaatttaaccaattgcaatctcttcaagatcttgaccttagtagaaatttgttaagcggaaaaataccagcagaacttgcaactttgcaaagattggaaacgctaaacctctcacacaacaatctctctggagccattcctgattttaagaatagcttggcaaatgttgacatatctaacaatcaattggagggttcaattcccaaaattccagccttccttaacgcttcatttgatgcattgaaaaataataaaggcttgtgtggaaatgcctccggtttggtgccttgccacaccccacctcatgataagatgaaaagaaatatcatcatgttggcattactgctttctttcggcgctctatttctattattattggtggttggaatttcgttatgtatttgctaccgaggagcaactaaggccaaaaaggaggaggataaagaagaaaaaagtgaggatcattattccctttggagttatgatggaaaaatagtgtatgaagatatcatggaagccacagaggggtttgatgacaaatatctcattggagaagggggaactgcatctgtctataaggcaaaattaccctcaggacagattgttgctgtgaaaaaacttcatgctgcacccaacgaggaaacacccgattcaaaagctttttcaactgaggttaaagccttggccgaaatcaagcaccgtaacattgtgaagtcacttggatattgtttacatacacgcttctcctttttggtttatgagttcatagagggtggtagcttggataaagtactaaccgatgatacgcgtgcaacaatgtttgattgggaaaggagggtgaaggttgttaaaggtgtggcaagtgctctgtaccatatgcatcatggttgctttcctcctattgttcatcgtgacatatcaagcaagaatgttcttatagatttggattatgaagcccgcatctccgacttcggaacagctaaaattctgaatcctgattcacaaaatataacagcgtttgcaggcacatatggatattctgcaccaggttaggccatttttgttcttaagaatttaatcctatatatatacttgtttcaataataagtcctgctacttgttttataatactatttttattattttgataaattacagagcttgcttatactatggaagtgaatgagaaatgtgatgtcttcagtttcggagtgctttgtttggaaataataatgggaaagcatccaggagatctcatttctgcattgttttcatcatctgcttctaatttgctattaattcatgtgttggaccagcgactacctcagccagtgaagccaattgttgaagaagtgatcttgattgcaaaattaacatttgcttgcttaagtgagaatccacgctttcgcccaagtatggaacaagtgcataacgagtttgtgatgccaaaatcatcttctttggatccactccccatgatcacacttggtcaactatctaaataattgaaacttgttttctggtgtgttctatgttttttagttttttggtgtacactgtaattaagcttttcgtgatattaatgtttttctcgagcatgttttgtatgtttctgagggagtgctttgtatgtttcttctgttctttaaagacttggaaaataatggaaagtcgcttatgtcttttgtaagatcgaataaataaagtgtgattttgaagggagcagtcatgtttttggtctttataaaataaataaagtcattatatatatataaagctactttatcaaaagaaaaaagtaatgtttttggtaagataaggatattttgactgcatatttctttgagaattatttgacgttaacggttagccactcgatgaagtatattgcatttaattgaagacactcccaagttccattatatatcaggactttagtaatctacaagaaaactcgtataaggatattttgaagaataaatttgaatacaaatgttatatattttaattttacacaaaactattatacggatcattttattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaaagaccttaactgcctaatcaaatgcattatttcaacacaggcttctttgctttaagttcacgtacttatctcctttttatttttccacttaaataaatagtattaatttagtatttctattttacctctcttttctcttttatccctcactatttttcttcaaatgactacaaaaaaaaaatggaattttcaaaggcaaaattccgtggctaacatcaaaatcacaaagatatataaatttaattttggaccttatttatctaaagcaaaagcaatttgcgattacaactcaaagaggagtcggacttacacgtccctaatccaaaataaacaagaccatattattgcctgagctagaaattatgggaagatcaagggaagccctgttaattgttgagagtttcatcctttggtgagtttcacttctggatttgcattatgggaattgtgacagactccttttttctttttctttttttaatagacgccttcattaatcattatagagctctgtttgacaaagttttatgtttggagagcctcctccctctcaatttaatactttaaggtttgctctgaatttatccgctaatataaagaacctcttattacaaataatgnnnnnnnnnnatgactatctaaactgatggactgggaattgtgagactccttttttctttttctttttttaatagacgccttccttaatcattatagagctctgtttgacaaagttttatgtttggagagcctcctccctctcaatttaatactttaaggtttgctctgaatttatccgctaatataaagaacctcttattacaaataatgtacacactatttcgaaaattcttcaagatacatagtgaagtcacccggggaaggattcaagtcttataaaatttatataaaaatgtgtaaagtgaggaagagtgactatcgatgtagcctttactttcactttttattttataatttaaatttttattcactttaaaaaaggccaacaaaaaaagaaaagggaatgcccaagttaatacgattcacactatgatgttcttgtttctactaaactagtaaagtgacctgtctgacaagttttaattttgaaaataaatatatctatattatacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgtgattataatatatattaaaagtcaaaatcatttatcagataattttcaaaatcatttaatttggtaaaaaaaaaaagggtaaattctcggctccattaccatcaacggtgtaagaatgtgcttctagtttcaagctctttctttgtgtttttggcttccttgtaattttgacttctctattttttgtcatggtagtagtggtggggaaggaggggatggtacattgtcccgtaaagtcactaacagaaaaagagagaaagtttaacaaaaaaatttaaatttgagataaaataaaagcttaaagaaattttttttattatgagaaacttatggattttgcaagctactccttaataatttttttcttgactatggtcattgaaaaatagactaattttatatttggtccttgaatttttttattttgtatttttttcctaccattacattggttttgttaagtgctccttgaaatatttttttatttgtcttttggcccctaaaatgttttccatcaattggtgacatctgaaattaacaaaatcaatataacaacattgattaaatataaaataaaatatttttttaaggatcaaaagcttttgtgtagatcttaagcaaagatcttgagcttaagatctgatcttcacaggatctcccaataaaggaagtggagagatctccaacatggagaattggttcttgtacaagatccctcaagatctgcacattattcaaaaaaagaatgaattttttctctctttttctcttccaaagatctcaaaatgagatctaccattaaaggaaaaaaagtgaagagatattgagagatctttaatcctatatggtactatagggtccaccaaaaagtggtataagatcccaatttaagatctaccactaaagatgctcttaaggatcaaatacaaaattgatgatttttttcaataataaaaaaattatttgagcaaaaaataagatttggcatattacatagtttagtttggatgtaccagatttgtattaccaccgcatcagatcatttggagtagcgttattgtgtactgtgtatagttgtttcaattgttttaaatattaaaagaaataattacataaaatcgaataatcttgttatatatatatatatatttatgttaatacttattttgatggtgtatttaaattaagaattgttcacatcgggaggataccataggaaagacggagtaccttaagattcaactgctccctcttaaatactctctccattgtgttttagataacttttaaatacaattattttttatagttttaacacaactattaaagatatgtaattaatatttcaaattttataaaatatattatgtagcattataatatatcctttatttttttggttaattagatttttattcatttgctatagaacaacaattattcttacctaaaaaaggttagtttcatggaattttttttataaaaaaaatatgtttggttacattttaatatccctttgaatatcttttagaattaaaataatttaaataaaaatacattagaaaagaaattaagagtactttagcatatcattatccttattcccatgaaaaaaaaaatctcatttccatctcttttcatgggaatggaagtgtaggaaaagtgtgataaaaaaaaagttagtaacatgtaacaaacatgagtatgcaatattttcatgtagcattcttggggataaacttttatttcgtgaaacaaacataaatgcactctaagagtacttcttggaaaataaaataaatttaatatttcattagttttgtaaaacaatatatatnnnnnnnnnnnnnnnnnnnnnnnnnnnnnnnnnnnnnnnnnnnnnnnnnncattattgaatatgaattgattgaatatcatgtgtgaaaataaaaaaaatgactatctatgttatataatttacacaaagttattgattgaacagtgaaaataaaaaaaataactatcttatgttatataatttacacaaaattatagcatacatggattaaatttatttcaaatagaaaaaaatgaaaacatttgtaaatcatatttgaatgaaattttaatcaattaaataattaattaaatcaaattaattttaattgattaaaatatatttttcttcaaataatggtctactatgaattttcataaatacaattaaatgaaatttaacaaattaacaaatcagtcaaattaaattaagtaaaaagatactctaattaaacttggtaggataaataaagtattactatattttttgttattatttggtgttaaaaatcattaataatttttaaaaaaaaattaagatgaaaagctgtattaatctaaagttattccgtgacacaatttttgataatatttttttaaaacttttctttgcttaaacaatttctgcgattgcagattgaaaaattaaaattataccttttttcttttcttttcgctttcattttctatgcatgatagtgattcttcgaagccaatgacgattgattcttatccgtgtagcaagtgccgtctgaaaagctaactgtttgtacggcgtgtgatgtacatttttcacactgtctgaggctttcgttcgatcttctttattctaaaatctactttcaaaataattcctgaaaagctaactgtttgggtttttttaagtagtcttctttattttattttattttgaaacaattcctgaaaaacttaaagtaaaataagctaaaatcaaatgcattacttcagcgcatgcttgcttccttgattccaatcagttagagcactcttgcaactccaatatgaatgtaattaagtaattgaagttctgttggattaattgaaaatcatctagccccttcttattttcaaccgttggaatatagtgtgattattatctcaaactcacccaaattgaaccaaattgcaactgattggtttatggtaaagggatgttggactatgcaactccaagagaacctgatcaagttggtgtcttttcaagtttggtacagatatggtgggaagattgtattgaatggcaaattatacaaatctttcaaatatttagtattaacctttttaaacttcaccccactgtgactcatgtttgatttgtctatatctaacccatcttagataaagactaagtatcataaaaccagcaaaaaatcttaacaaatctgccacttcctactggtttagttattccaacaatctctaaaataaaaggccatgatcctcaacaaggtactattgaatatacaatgagcatatttcataagcaaaggaaggtgaaacagaacttacacagaaaaaggcaaccgtccctgttccaaaataaacaagatttgacctataaaataacaccatttaacaataatatgcataccgcttgagcagacacaaatgaatctaaagtcacatgactatctaaactgatggactgagttaaagtattaggcactttcattgtaaataactggcatgtgcctagtcatgctgccttgtatgcacgtactggttgtatgcaaccaaggttttaaattacggtcaggtcccgttagagtttcattgcagtatttgatgttgtggcagcgttgattttatactgcaacagaaattgtcattggataccattttttaacaccttggctgaaacaagaagtgcatggtcaaggaaagtgggactaatatgccaatgtattttacattttgtttctttaagcattgtttcctgagggaggaggaagctagcaaaattctaaaatgtgaaagttgtagtaacaaaacaaacaaaagatataaagttagggacggtgcctaagattgaagaagtccacactccacaatgttgtacttgtagacctaaatttcagatgcctgacagactcacgtggttgtttgctttgagcatattccaccctggctgctggcaaatatatgtaaaacttgaattgtgttgttgcctgagattgaaatggaagatagggtcaagcggatgatgtggatgcgatgtttcaccaaactggtggagccctgttatccaacatttttttgaaacccccctgttatccaacgttggtgagtttcacttttggatttgcattatattaagagtttgaaaagttttccctttggagagcctcctcttattcgctaatataaaagcctctttcttatcaagaatgtacacattcttgaataaagccttcaagataatagtggaagactaattaaggtcttcaagatatacatagtggaagactaagactcaggcattcagctcttataagtaaaaactaacgtgtaaagtgagaaaggaaacagtattgattgtaccctttaattactttcactctttgttttatcactttttaaatttttatttactttttaaaaggaaaattaaaaaaaaaagggaatgccaagttaatgcatttcagacgatgatgttcttatttccttattatttttataataattgctttaaaaatctatatatattcttgtccaattatatttttaacatataaatttataactaaagcataaaaaaatattcaaacaagaaaaattaaaaaaaaaagcatatataaaatacttcatctacannnnnnnnnnttttcaatagcaatcccccagctgacaaaggcaaagccatcaatcaaacatgtcggttaatcaaatttttgtttgcacggctctgttgacaccaggggcaattatgtcaggctgaaacagaaaataaagtattgaatgtaagaaaatggaaaagaaaaatatatcatgaagatgaaatgaaatgtagaccttgagtatcaatggttgcactgcattgggacccctggatgagaatccagccacaattggagcaggctttattcctaaatatgttcttgctacagtcatgtaagcaacaagtttcctgcagagaaatttatagattaagtttttcatttgctgcaagtatttttacaatgtaagtaacactgaaatgaaattggcttagtgtctgtttgaattcatgtcagatcatccaaaatgaccttgaaataccaactttcctgattttaaataaatatgtacatgcttggtctcccgttggaaaattgattctgaatcccaaattaaacaatttatccggtggtaaaccgccagagcttggccaggcacccaaattacaacaacttcaactctcttcaaataatataagtggaaaaagtccaaaaggttttcgtaaattgaccctgttgtttactctctttgagtcacaatgaattttctaactacattcccacagaaatgggatctttgctaaaccttcaacatttgaaacttgcagcaaatagtctaactggtccaattccaaatcaacttggacgactgctcaagttaattgacttgaatttggcaataataaattatcacatggccttccctctggatttaactaattgcagtctcttcaaactcttgatctttgtgaacttgttaaatggacaaataccagatcacttggaaagttgcacagattggaaaatttgaatctctcacacaataatctctggcaccattccatccaatttttaagaaattgttaagtttgacaaatgtttacaccaacaactaattagagggtccaattcctgataatgttgaaggtcacggctatggtactgctaagggaggctccccaagagcaagcgttgtggcctacaaagcgtgctggcataaactggataccagagggtgccatgaagcagatattctacaagcatttgattatgccatatatgatggttttgatgtcatctctgcctgcctccgtgggtgcgtctaatccctataccgaagctttgttaacagatgggatatccataggggcattccatgcagttgccatgaacatagtcgttgtttcctctgctgggaatgaagggccatcacctttaagtgtcacaaatgttgcaccctggtccttcaccgttgctgctagcacaatagacagggattttctcagcgacatttctctcagcaacaatcaatccattacagtatcatctttctatacttttccttaatttattaattagtttcatatgtttttattatgtacgtcaatttaattaattggaacgtgtgtgtatatatcagggtgccagtcttaatcgaggcttgccaccatcgtcaccgtcgaacaagttctatcccataattaattctattgcggctagacttcctcatgtgtctattaatgatgcgtaagcacaatttttgtttttatttccaaagcttgcttcaaatatttatatgtacttgtctcatacgtgtatatgtatgtatgtatatttgttggtgtagtcgtctttgcaaagcggaaacacttgatcctagaaaagtaaggggggagacactagtatgccttcgaggtgataaattaacttcagttagtgagggccaacagggtgctcttgctggtgctgtggcagtttttgtgcaaaatgatgagcaaagtggaaatttacttctggtcgagaatcatgtattacctgctgcaacccataatgaaagtcaaggagatgctgtcaagtttaaacatcagcagcaagtaaagttcatatatatatatatatatatatatatatatatatatatatatatatataaacacttaattaatttctacatgtattgttgcaggggggtattagcttacttgagagcggcaagaacatatataggagtaaagccagctccaataaaagctggattctcatccaggggtcccagttccgtgcaaccattgatactaaaggtctacttacattttgttacaccaacatgacatgatgattttccttcttacaattaatgactcatgtaagataaacttgccgtaatgtgtttctttttcagccagacataactgttcatgttgtgaacataattgcagcttttacacaaggagcaggtccgtctaatattgcatcagatagacgtcgatctcttttcaatgtgcaacatggaacttctatggcttgttctcatgtcgctggcatcacgggtcttctcaaaacgtaccatcctacttggagtccagcagctatcaaatcagctattatgatcattggtactaataattctatttatatgtaaattctcaatttaaattatataataattatttttttcttcttttaatatttcttttgaaatatataaatttagttttttttgaacttttatccaataaatcctaaaattaattgatttttagtgtattgattgtattttttttttgtataattacacattaaaaaacttgaaagatgaattgaggatatggacttaatgcgtcaccaatataaaaaagtccaattaaacaagttttgattgtgaaaaggggaggagagaaaaatcatcaaaagtcagaaacctaagacataaaggagagaaaaattcacaccaaaaaagttgacttatgcctcttatttaatcggtcttcttgcattttctttcattaattattttttccttttgtttttgtaaggctctctgacaaataaagactaaattctacttggagtcgaactatcaaatcagctataatgacaataggtacattaatattagctatagtaatatatatgcatttttaattacaaaatactatcatatgtatgcagcatatcatttggacaaacattggaggcttattaattaacagctatgctttttatttacttcagctacaacattagataacacgaatcaaccaattcggaatgcatttgataagaaagcaacccccttcgaatacggcgccggacaaattcagcctaaccttgcaattgaccctggactcgtttacgatttacgcaccaccgattacttgaacttcttatgtgcttctggttacaaccaagctttagtcaagttgtttaattttaattggggaaagtaatttattaggggattcaaaattcttcaatttaaaattcactatttggatatttttatataaaaaatttaaatttttggaattttataacataattttaaacaattaaaaatgtggaatttgaatttccctctaaaaggtgagaaattaaaattctcttcttttttagaagctctaaacgcacaattttttgctacgtctcaatcaccgacatactccaacctccgctactctcaagacaccatccatcttacgtgtttttttcgtgaataaggttcaaaattttaaaaatgaagaaattcaatttctttatccaaacacaaaattttgaaaataaaagaattttaattgatgcattttaatttccctgaattttaaatttcctgaaattttaaaatactccatccaaacatactcttagagtgtgtttggatagataattttaattgggaaaagtaatttattaggggatttaaaattcttcaatttaaaattcactgtttggatatttttatatgagaaatttaaatttttggaattttataacataattttaaacaactaaaaatgtggaatttgaatttctctctaaaaggtgagaaattgaaattctcttcttttttagaagccctaaacgcacaattttttgctacgtctcaatcaccgacatactccaacctccgctactctcaagacaccatccatcttacgtgtttttttcgtgaataaggttcaaaattttaaaaatgaagaaattcaatttctttatccaaacacaaaattttgaaaataaaagaattttaattgatgcattttaatttccctgaattttaaatttcctgaaattttaaaatactccatccaaacatactcttatagttttcccaagtcttacagaattgaagatttcaacaatccttcaattacggtgcatcatcctggctcaaagactattaatgttacttgtacagttagaaatgttgggcctccaagcacgtaggttgtgaataatcactggccgaagggtattaaggttcctgtctgttgcgaattcggcaagtataccgatcgttcaagtaataaaatgattagtgagttatcgttcccacgaggattgtttggtcaattaaatcataaatcgtatctcaaggttggatgacaaaagattaagagagaattgtgttggacaaagtaattcaaaaactaaatgtaacataaacataaacataaagcattatatacaagatagatagtggttgtaccaaacgcaacctaaagtaactagggaacccacattcaacactcctagcattcttcatggattgattgcaacattcatccacaccatctactgtaatgaaggcagatgtgatactgacgtgcggataaggacaaaagcagaaattatgagagagagatagtaacagaaaagagagagagatagatattctgaatattgctatccttttttttattgagcctccaagctatttataatattctcgacaatataaaactagacagtattttaaaatatctagctaggcactagattaactattgaagcataatggacccttctcagtctaaaacgtaatcttgataacgtgctggtatcttcctcaatctattattatcttccttgttagcaattggatttgggctcatcccacagtctgttacatcattccctcctgcaaaacttgacttgtcctcaagtcgtggtagatattttcccaagacaggtgtaaccaacggattcgttggggtcgacaacttggatgtggaagatagctggttagcatgagttaccagggatggctcagatggtgccaatggaaaagaagaaatctcaaccgctggaatttgatcttgatcggatggacttttggacttttgtaacagagggatagatgtagtttttgtctctggtttaagttgcttataagacaaaagcggatcacttttgttcttgtcgtgaggcataatctgatccttcgttaaggagggtccttttgctatcatctccgaacccggcaaggagtggtttgtgtgactcaaaaccacatcttggtcctcccatgtggaatcctccaacggaagatcggtccattgcaccagaacctgaggaaccagggtattcttgcgccatatttgtctagtactcactattgcttgtggcgtatgcaacagggggtcatgagtagtcgttgccggaaactgatgaatcttataacgatggcctgagcgaaagggacgaagcagagaaacatggaagacggggtggatcttcgccgtaggaggaagacgcagccgatatgctacagagccaatgcgttcttcaaccacaaatggaccataataacgcaaagccaacttctgagacgatcgtcgtgccattgaaatctgacgatacggctgtaaacggaccaaaactaattcgcccacggaaaggtgccaatccttacgccttttgtctgcttgtgctttcataacctgttgagatctgaataatttttctttcaatgttcccatcatcttcatgcgatcagagagagtcgtgtcgactgcttcgttggatgaagcaccaagacagtaagctaaaagatttggaggagtgcgaccgtacatagcctggaacggggtagtgcctgtagcggtgtggaaggacgtgttgtaatggtactccgccaaactcaagaacttcgaccagcttgaagggtggtcatgtgagaaggcgcgaaggtaagtctccacacaacgattaacacgttctgtctgtccatctgattgaggatggtaactcgaactaaaattgagctttgtgccttgtaatttaaacagggaacgccaaaaatcactgaggaaaattgggtcacgatctgagacgatggactccggaatgccatgaagtttgcctatgtgatcccagaaaagttgagcaactttggatgccgaataagtggaaggaagatgaacaaagtgtgctgccttcgagaatctgtcgactaccaccaaaatcgcggtgtaacctgcagaagaaggtaagtgagttataaaatccatactcaaatgactccatagggtgtcaggaagttgcaagggttgtaaaaggccaagtggtggatgatttgaaggtttcaatttctgacaaatttcacaattttgaatgtatgttttgacatccttccttaatcctttccaggtgaaatttcgcgttatgcgctggatggtagcttgaacacccgaatgccctccttggactgagtcatggtaatcatggagaatgatattggtcaaggaagaacccgctggaatgaatatacgagagtgatgaaaaaggaggccgtttctgaaactccaatccgacaaggaagtggaatttagttgtaaatcttgtataagctgagtagaataaggatcggaactgtattcggattgtaactgagtggtataattaagctttggaacagacatggccaataattgggatgactgaattgcaggattcccgtctggtagtcgagacagactatccgccaccgtattagttttgccggccttgtaagtaattgtgtaattgaaccccaacagtttggataagaactgttgctgctctggtgtttgaataacctggttcatcaagttatgtaaacttttatgatcagtgcgaattgtaaaatgggcaccaaggagatactgtctccacttggtcaccgcggatgttatcgcaaacatttcgcgaacatacactgattgtctctgcatggtaggagaaagtttcctactaaagaaagcaataggcttctcgttttgtaatagcacagcaccaattcctatgcctgaagcgtctgtttccaccacaaagggttgggtaaattttggcaaagtaagaattggggcggataccagtaattgcttaagacgatccagcgcttccgttgcagccgtagtccaacgaaactcagccttagcaagaagatcagaaagtggagctgcaatggatgcatatttctgaatgaatttgcgataataccccgaaagtcccaaaaatgctctgacttgagtcacgttagttggaatgggccagtataaaatggcttttaatttatcagggtctggttgtactcctttgccagaaataatatgacccaaataaggcactgcagcttgagcaaaaaaacacttctcctttttagcaaataaggaatgagatcgtaaagtgtttaagacagttgtgaggtgatcaacatgttgctgaggggattgactgtacaccaaaatatcatcaaagaagatgactacaaaacggcggagaaacttggaaaacacattgttcattgtagattggaaggttgaaggagcattggaaaggccgaaaggcataaccaaaaattcaaaatgtccatgatgtgttctgaaggctgtcttatgaatatcatcaggatgcatcttaatttgatggtatccagagcgcaaatcaagcttggaaaacaccatggcaccaccgagttcatccaacaattcgtcgattgttggaataggaaacttatcctgaactgtcacagcattgagggcgcggtaatcaacacaaaaacgccaagtgccatccttcttcttaaccaaaagaacaggagaactaaaagccgaatgactatgctgaatgattcctgcttgtaacatatctgccaccattttctcaatttggttcttttgatagtgtgggtatctgtagggccgtacttgtataggctgtgaatttggcaacaagtgaatttgatggttataagccctttcgggaggtaatccggaaggctcctcaaaaacatcatagaaactgtccaatagcaagtgtaagtccggtagtaatgaacttggaggatgggatgaagtatcagaaggaaccatagtagtggctgtggaaaggcacatgagacaagatgaaatggaatcctgcgataccagtttgcgtaactgagaaggactaatatggctgggtgtggctggtaaatcgccagtgatacaaacttgggctttattccacacaaatgacatagtaagagcagaataatcagttaaaacagggcccaatgtggacaaccattgtactccaagaaccaagtcagctcccttaagatcaatcacgaataagtcaacagtaaacaaatgagattgaatgttcacaacaatagccctacaacttgcagaacatactagtgcatcgccattgtttgatgttacgattatcagcaaactgctcctcatatatttttgcaaaagcgaaagttgctgtgacgtcttcgggtcgatgaaccaaaactgctctccgaatcggaggtttaagtcccgaaatgaaaaggctcttgcgagttaaaggtgttaactcgggaatccgattagcaaggatttcaaacgaggattgaaactctaaaacggaaccagtctgttgtaatttagcgagagaccccaaaggatcttcaaattcagaaggaccaaaacgctgatgaagcgccgtaacaaaagaaggccaatcgggaagctgacccgtgccaaacaaagcttcgaaccaacaagaagcaggtagatccaaattgaaagaaactaaatcaagtcgatcttgaacaggaacttgatagtatcgaaaatacctttcaatggcaaataaccaaggaccaggatctcccgacccgaagcgaggaaaatccattttcatggaacgaatcggatgggcattacgtccaggagaggtacctaaaaggccaccctggttgttcgttgctaactgagttatctgggtctgcattgtttgcaataaggcgaaaaggtcctggacctgacgattgaggccctccaatcggtgagtatgttcctcaaaacgttggttctgggcaacctcaaaggtctccaaacgatgatccatcgttctctccagtgtagcaaattgttgctcatgaacatgaatttgattggttaaatcgcgcatacgagtgttgtcagccatagttcaggaatacaatgaaagcaccgatgtaatgatggcagatgtgatactgacgtgcggataaggacaaaagcagaaattatgagagagagatagtaacagaaaagagagagagatagatattctgaatattgctatccttttttttattgagcctccaagctatttataatattctcgacaatataaaactagacagtattttaaaatatctagctaggcactagattaactattgaagcataatggacccttctcagtctaaaacgtaatcttgataacgtgctggtatcttcctcaatctattattatcttccttgttagcaattggatttgggctcatcccacagtctgttacatctacccaatcatgcatcctcattcaatattagttaggccctaattccttagtgacttgtaaccctttaaccctttttcataccctaattccttagtggtattttattaggttaagcattaagcgatacactataagattgcaagcacccatccctatccctaggtgatgttagcaagtcaccacacttggttccaagactaaggccccaacatccctattgtgaaccctagctctaaacactcaactagattgatcaagtctagagaagagaaggaaacattcaagcaaagtgtaatgaaatagcatagcattaatgaacattcaatacaatccaatccaaatgtaagttacattaaatgcttgccctaaatacaagaggaactagccaaacctaacaaggatggccttggtacaacaaaagaagcatgaatggctgagatgtaagcaaggagaggaagggaagagggaagaaacctcttcccctcacacccaagccctagctaagcttccaagcctctccttctcccttggtagtgattttcgtccaaaaggggatccccagaactgaagtgggttcttgtatttatacttgggtaagtgaaatcccaagattggcccttgacagcattgcagaactgcagatttaagatctggcgcgggtcgcgcgggtcacggcgctgatggcgccactcttttagcattggcgcggatggcgccaacttccagaggaaatctgttttctagagcagcacccacgcggatcgcgtgggagtccacgctgatggcgccaactggaattcatggcgctggacgcgtggtgaatggcgcggatcgcgccgcatcttcttgtctgcttttcttcttctcttttgctcagttttacctgccaattacttcaatcttgaccaaaatatgtcattaaagcttatgaatcatattcacaccaaatggaagctattatcatataaaatgatgcatttaatggcttaattgagcttggaaacatcatgtgctaggcacatatcactgtccaaccaagttcgttgacttttaagaaaactggagaaaaaaagaagtttcaggttattcttcaggcaatattaattggtgtgcctagtcacaacattcctttatttgggaatttgtcttggacagatggcaggcacagagtaaccagtcttgttgtaatgctgtaatgtaaccttagaagttagaagttgctctcagcattgttatggtatcattgtcacttaagtgtgtttgcattttctttttttaggctgtaatataagcgtgtttcctactcctgttgtattaaactttttctaaactaataggcaggtttaaaattttgaggtattgaactttgttgcatttattgggagctatgtttgtaatgggcacacactatcatgtatggaacctgtatctttgaaagtctaataggcattgttgagagttgagacccatatctaaataatattgaacaattttaattaggctctaaatctatcaatttgccttcaccgttgatttctcttctttctattttatctcgtgcagtcatgcattcatcttcacctacctttagtgttagctgttgatgaactaggatgaattgaattttataaaataattcataatttaaaatcaaacttaaaataataatatagagacaagagataaataagacaattaattttaacgtgaaaaatccaattgggaaaaaatcacgacgtccaaattggataaccaatccaatgaacaacttcaatatgataattttgtgtacaagagtttctatcctagtttctcaattatgttgatcttcataaatccaaaatatcagtaacttcaaaatatcaaataatcaaataattatcatcagtgcaataaatttaataatgtgacattcattgtttgttatcatcaaaattttataaatttttttatgcattaggggttcaacaaatatccaacaatttctctctttttgatggtgacaaataattaatgtcatgtactaattgaatgaacatatatactatgaatgcactatgaatgaatgatattcaactttatctactaatgattttcaactattctctagtcttgctaagctatgactagaatcaatgactcacaacaatctaccataacatggcattcaaacctcttcccctcttttggcatcatcgaaaagattaaaacaaataaccatgatagagagaatgattaggaatcttagcatgaataggattacatggggagaacaacatgaatatagttaacaatgaagaacaagaaagtgataaagataaaagacggcaaagaaattaacattctaaaacacatgccttaatattgtaataaattgtcttttcgttcatatttaggatcactttatgttcttattctcaagacttttcataagcttgtacatcatgactgctctccactcttagtatgaaaatatttcataagtcattaaatcaataggtctttataagcttgtaacgtacaaggtgaataagaaatacacaaagaataaagtgagataggaaacaaataagtatagtactgatatgcatagtttttcattttcctctccacttaatacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttcttttttctttgctttagaaactatgcatacccacacctaaaagaaattttttaatcaaaatacaaagggttgcatattgtgactagggatataaaatactgaaatgattaacttgaaaggctcaaacaatcaaagatgacctatatcattttcaataaacttatgaaacatcttaaacgatgagccttgagcttcaatgatacaagttctaaattgtctatctcacagagaaaatacacatgcacattattcttcacaatatagaaaattcattacaatatcaaaacatgtacttaagaattaataacacaagaagatatataaagtgaacgatgtaacatagatacatgaatatagaagtgagagaaataagataatccaatataagctaaacaaacgttattagaattggtcttcttttatgtaagacttgttctttttataagccagaaaaaataataaatatataaaaatgacgttcccaatttctcaacatcaaaataaaataaaataaaaataattcaagtgagaaatcgggtttgagaggtcaagttctctacgtgaacagtaatggtgctagctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagctgtacgtataaataatctggagggatattatttgagtaattattttttattttgtattatttgagtaaaaaaattgattgaatgatttcttatttattgatggtacacaaatctttatttatctgcaaaagaatctttatttacataaatatatttgttaacgttttacaagaattttttttcctcaatttgtatttataaaaaataaaaaatgtcacttttttcttttttaaaagaataataaacataattaatgtataactataatttacaagtggggaccacaatttttttttggatttggatgcattaactttacacaggaggaaaagtcagtatcactttcatcaatcttataatccaaattttacaacttgttttaaaagatattttttaattttttttttttactttagttattaatttatcactttttactttaaacccataaaaaatactactaagtgtgtagattaattgttaccaggtatttcagtatagcacatggttttgaggaaaaaatttattgcctataaactataagggtctatctacttcaagcatgattacatttgattatatttgatgaaacataccaatggtctagataaaaagaaaatgtcagaaattttgtagcagtactgctagaaatttctttaaccgtcttatatttgtcaaacattttctctgacaattttctaaatgatataaaagactattaattaaactgaaataatcttgtattaattaataattattctatatctttaataatgtttttatggttttaaaatatacaagatataaaaattaaattaataatcaaattagaaatatctttcaaaacaaagtgttaaaattcgaactatcaaattaatctattattttaaaatgagattaagtaattgtaaaattcccaataaatctaatccatgctttctaaggccacgctaggtagtaggtacgtcatttcacattaataatttttctgctatttcattgcactactagctatgatcgaggatccatcatcttctgctattccataatcacccaatagctcaaatatgatgttctctaagctttcattaattcgtctaattctctattcactcttaagcctccattcctcccaacttttcacgtttacttcttttgcctttgctgccatcactgctgaaaaccatgagagggaagcagctgctctacttgagtggagagtgagtcttgacaaccaaagccaagcttctttgtcatcatggtccagtgctgtaagtccttgcacgtggaaaggaatcgtttgtgacgaatccaactatgtgaccgctataaatgtggcaaatcttgggataaaaggtactcttcacagtctcaaattttcatcttttcccaagctgctaactctggatatttgtaacaacagttttaatggaatcattcctcagcaaatttctaacttgtctagagtttctcagttgaaaatggatgctaatctttttagtggttcgacccccatttccatgatgaagttggctagcttgtctttgcgagacttaacaggcaataaactttctggtaccattccatcaattagaaacttgacaaatttataacacttaagctcgcaaacaatagtctctctggtcccatcccaccctacataggagagttggtgaatttgaaagttggtgattttgagagtaatagaatttcaggatcaattccttcaaatattggaaacttgacaaagctcgacatggtattcttagccgataacatgatctctggatccgttcccacctccattggaaacttgatcaatctagagtcgctggacctttctaggaacactatttccggtctgcccttggaaatttgacaaagctcaattttttcctagtgtttaataacaaacttcatggtacattaccaccagcgttgaataactttaccaaacttcaaagcttacaactatctacaaatcgtttcaccggtcctttgccacaacaaatttgcatagattggttactgagaaaatttgctgctaatggtaattctttcaccggtccagttccaaaaagcctgaaaaattgcccagtcttaccagagtaaacctatcaggaaattgcttgagcggaaatgtctcagattgcttttagtgtgtatccagagttatttttaaaatcatttctaaaaatagaaaataagaagaaaaaaatgaaatgaaattttacataagtaaaaataagatctgtattagctaatttttagaagctcatcaatgtaacttctctaaaagatgagatgacatttacatatgaactaataaaaaactcattttagcttatgaagaaactcatttcattttttcttcttactttctttttctaaaagtatttctagataaacttacattcaaacaggtccttcgttgagctgagtagcaatagtttttatggccacatttcaccaaactgggcaaagtgtcctagtctcacaagcttaggatatccaacaacaatttacctggtggtataccaccagaactagaccgagcacccatgttaaaggaacttgtcttgtcttcaaatcatcaaacacgaaatattccaaaagaacttgggaacttgacctctttttggcaacattcttaccgaaataggtgctttgtaccgccttgaaaatttggagcctgcagcaaataatttaggtggcccaattccaaaacaggtgggatctttactcaaataggttcacttgaacttgagcaacaacaaattcacagagagcattccttcgtttaaccaattgcaatctcttcaagatcttgaccttagtaggaatttgttaaatggaaaataccagcagaacttgcaactttgcaaagattgaaaacactaaacctctcacacaacaatctctctggagccattcctgattttaagaatagcttgcaaaatgttgacatatctaacaaccaattggagggttcaattcctagcattccagcctttcttaatgcttcatttgatgcattgaaaagtaataaaggcttgtgtggaaatgcctccggtttggtgccttgccacaccctacctcatggtaaaatgaaaagaaatgtcatcatgttggcattactccttgctttcggtgctttatttcatcaaagagcaacaaaggccaaaaaggaggaggctaaagaagaacaaaccaaggattatttttccatttggagttatgatggaaaattagtgtatgaaagtatcattgaagccacagaggggtttgatgacaaatatctcattggagaagatgggtctgcatctgtttataaggcaaaattaccctcgggagagattgttgctgtgaaaaaactacatgctgtacccaacgaggaaacactcaacataagagcttttacaagtgaggttcaagcctcggcagaaatcaagcatcgtaacattgtgaagttaattggatattgtttacatcctggcttctcctttttggtttatgagttcctagagggaggtagcttggataaagtactaaacaatgataactgtttgattgggaaaggagggtgaaggttgttaaaggtgtggcaaatgctttgtaccatatgcatcatggctgctttcctcctactgttcatcgtgacatatcaagcaagaatgttcttatagatttggattatgaagcccgagtctctgattttggagcagctaaaattctgaagcccgattgacaaaatttaacctcgtttgcaggcacctatgggtatgctgcaccaggttaggtcctttttgttattaagaaatcaacgctatacttgtttcaataataagtgctgctgccacttgttgtatgatactattttcatacttaatttgatatattacagagcttgcttatactatggaagtgaacgagaaatgtgatgtcttcagtttcggagttctttgtttggaaaggatgatgaggaagcatccaggagatctcatttcttcatttttttcatccactggaacgtcatcagcttctaatttgctgttaaaggatgtgctggaccaacatgtgtataacgagtttgtgatgccaacatcatcttcagtgaatttattctccatggtcacacttggccaactcgtagataattgaaccttcttgtttcctgcctgttgtaagcttttttattgctttaactagtgaagaatctcagcacggtttaccacagactgaatgtagatcagtaatgatcaaaacagaataacatgtctcacattctctttattcctcaactcactgtgttgttgttatacataatgtttcttgatttctatatgctgtaatcgtgttagaatcatataaattgcattagatttacattggctatactctctatatctcaattacacaattacataatctaattgtgtctataagttttcaagaaaataattttgggactgattttgagaaattcagttctccctttctttggattttttaccatttgtctaatacatatattcaaattcatatattcttcaaaatatccatatacgagttttcttgcagatatatttagccatagtcctaaaaaatatttacttgaagagttttccgtttgtaaaagagttcaaccttgttattttattccgttagttctgtaactatcgtaatcgattattgcttcaattaatcaattaaactatccaacaaaacatctaggttaacattcagatcaatgtaatcaattattactgaacgagtatttagaaactagtatccaagcaaagcaaccaattatgttaaatggtagttgactattgcctaatctactgctttatacaaaaactagttactgtggtatcacaggtcctcacacacactgatgcactcacacaaatacacaacaatttctctagtagaatacttctgatgtatttagataatggtttgccaagccacacattggccttttacatgagatgttatttataagtaatagtaactcttcacctagggacatgattcttcacataagtaacttcttcacctagggacacgactctttacatgagtaacttcttcacctagggatatgactcttcacatatctaatttattattattaaagtttaatccaacaaaatctccccataaactttaaatatttcttccgtctttcatccccaacatcttcttacaattttccagcagcaatgtcggtaatggcttcgtgaaaacatctctgacttttgaaatggactcctagcatgcttgcttagcacacattcttcacaacatctcttttaacagctcaaactcggcaacccatccaccattttcttgttcatcaactcggccaggcctccgtagtgaagatgcccaaaccggcgatgcacactcctcaacattagtttgaacattctatttttttccaaacagccgacctgcacactcctcaacattagtttgaacattttatttttttccatctgaactcgaactatcaaacgtccttgtttatctttcaagaggagaactcggtctatcatgagaatcgagtagccattctccatcagttgtcccacactaagaatattattttttagatcaggcacgtaatagacatctcggatgcgcccaattcgtccatctttatgcaagaaacaaatcgtacctcggcctttgacatcaacctttgaagcatctccaaatgaaacatgttcggcttctatttgtctcagattactgaacaaatgcttatacccacacatatgattgcttgcaccagtgtctagataccattccatctcggatccctggttgacttcacttctagtcatcatcagaattcctccatctcttacttctccttctgtaacaaggtttgaagtttcatttcttctttcatctcggcaatccttcgcaaaatgtccgactcaaccacagttgtaacatctgtccgagttgcaatctctcgagtaatgtccatactttccgcatttaaaacattgaacattcgattgatttgaatgtcagcttcttccatgacctcggcctcgccaattctgccgacttgattcagcctgctccttattccttccttcttgacctcagcctctaccacctcagtcatgtccacgtccacctaggccacgacctctatctcaaaaattgtgagaatagagcgctttctcgtctttgattgaagcttttgtcttaagtgcttgctccagtgactcttctttcttctttttctttccttgttcatgtgcctccaaggaaccaacaagttcgtcaacggtaagcgttgctaggtcctctgactcctcgatcgcacatacaacattctcgaagtcgtcaatgagagacctcagaattttctccaccactctggcattggacaacacctctccatttttgtttagttgatttaccatggtctggacctgggtgatgaaaccagataccccttctccttccttcattttcattccttccaactctccaaggagaatttgaagtcgaacctgtctaactcgatcgactctcttgtagacatttgcaagaatgtcccacgcttcctttgaagttgttgcaccagcgatcttctcaaacacggaattatcaacagcccggaataacatgtacaacgcccctttgtctttcaacctcgtctctttcaatgtcttgttctgcgtcgctgtatatcctgttgtggatgttggttccttgaaaccaccatggacaacctctaaactatcatgggctcccaaaagagctttcatctggatactccagttttcgtaattagcctttgtaaggcggggtagtggcagactactacttggcccactctctattttctcatgctctgataccaatttgtggtatcacaagttctcacacatactggtgcactcacacaaacacacaacaatttttctggtagaatacttctgatgtatttagataatggtctgccaatccacatattgaccttttatatgatatgctatttataagtaataataactcttcacctaggaacataactcttcacatgaataacttctttatctaaaaatatgactcttcatatatctaatttattattattaaaatttaatccgacagttagataggtatgtaacataatagttttgctggtacaagaagtttatatgaaatcagaaccgtgagaagtatttcattcatacagcagcaaaatgttatgtttctgatccatatactgacagaatagcacagcagatttctactacctaacaggttaatgagccacctgtccaacataaatacaaagcttaagacactccaaaaggtataggtggttgtactttagtctgaagatacattaattactgcataaaatattaacagttttcaaccatcaaattaacaagattctttgatttaatgattcatacataaaaaaaacttatttaatgctagataccatgcagaaagtgggactaatatgccatgtagttagtactttgtttctagagagaggaatgaactagccaaattctaaaatgttagataccctgtctacaaattttgtggcagtttcaccaaaaatacatcatgcatatatattgcggtccgcactatacaatttgtacatttaaatttcacgtgaaactttggccccttcgacgctggttgtttctcgattcagggaaattacgagatatatatatatatatatatatatatatataaattaacttaataattatacatttttattttaatctcatattttgaataaggttttatcacattaaaaattttagaataataaattgattatatttattaatcaatattatgtttattttaattttaatttatatttatttttctatttatttaagtgtttattataatattatacttataataattaaaaaatggaaaaaattaaaattaaaatatattttgattaaataatcattttcgtctctaaatgtataaaatgttgataaatttatcgttgaatgttacataaactctttcattaataataacatgtgaaattaacaaataaataaatttgtcacatttatttttactttcgaaactaaaatttaaatttttatatttcataaacaaatttatcatgttctacacattaaaaacaaaaataattatctaccctaataataataatgataaaactatcaagtttgagacacagggaagaaaatcaccaatactgtctttgtctcgtttccaaacacacttttccttactttattccgagtttcctttatgcgttatgcctggcaactttgtttatagtgataatgcactttcttaaagtgaagaaagattatttattttaaattaatcattagcatttcaacatatcatttatattataaaataagtctaatttttttataatttaatttttttttctttttcatttttgtaaaaaatgatttaatccttataaaatgtattttttttctttaaaatgctttaaataacatttattttattgttcaaaacatttattttaatgttcagattacaatctaaaacattttaaagataaaaaaaaaaataaatatattttatgtacagtccaaaatagtaaaatgatacgtggtcacctcatataaatgtcaatgtacacgtgatcaccctccatgtcagcattgcctcattaataggtgcttattcagcctctaggtgccagcccggacacagtgtctgggttccttgtcaacaccgctataggagcgcggacattagcaatattctctctccttgttaaatgtctatctacatgtaaggatattcaaataggtgtaaccaccttatcttatcatatctcaacaagttatctactaattgttacttatctacaagtaacaatatatcaataaggtacacattatctcttattcaaattaagataactgcatgttattatatgttattattatcttatcaacagattatctataagcaatgttctaaggcccactccatgctataaatataaccctccaggttctctctactcactcgattcacactccatactcattcagtattcatacaaaatacctctctctcatatacacttgaatgcattactcaagtctcttattctctatattttaggccgagtccatatacttggtcatccttattaatttaatgtacttacttgagcatcggagtgttttttctttgttttgcaggtccctcctctgagcaaagtctacccacactctggcgccacagaatttggagtccaccaaggccacatcaagccaacatgtgaaattttcagattttgacaagaacattttataaggactaaaaaaataccaagaaaaatgaaaaaaaaaaaactaaactataaataccaaacaagtatgttcttataagcatatgctactttaagaatacttaccaagaacctgttccaataagcatttcttaggatgtgcttaatagaagaagaaaaaaatatataagtgagcgaggtgtttgataaaataagtgagaaatacgataaaaataaaagtatttgattttagagaaataaaaaaataactattcatttattttatttatattctttttttggttactaatcattatattaaatctgaaatcttatttagaaaatcaaatttaatattatttaaatcaatgttatgttgattttttcctttttatttctttgaacaagttactttttttttttcttctaactatttatttctcttcctttttaagtttcaccacatcagcacctcggatggacttggaggtgctttaatagatggctgttgccctgttccgctttttacggagcctaatcttttcccaccaaaaaaaaaaaaaacaaaaaagtcttattccccaacgtacatgaacaaagtggctaaaacatgcagcattttcgttatccgagtgaatatggaagagaaactttagagcatattaaattattttttatttttaagattttgtaaaataaattatttatataaaataattagatttaaatttaaaaaatctacaatattaattggattttctctaactacacaaaataagaaattattttttatcttaaaaaattcatcaaacatcttatattgaaaatcaacttagcaaatttcctcttttttgaacggtgatgtggccatagtcaattagtcattgacttatgattatctttggaataactttatcttttctctcctaaaaaacagagacaatacataaattggctgtgaatgtgattggagatggagaaggctcgtaggaagagaggtcaagcattcatatattctctgttgttatggtaggtagcagtggtggtggtcactaaaaagaaaaaaatatagtgtgtttagcaaaagaaaatgaatttgagataaaatttatttatttttttaactcaaaataaaattataattaagcaaagtatatgatgtatacatattttaattttgatctaccagatatgtatatggttaatcaatagaattcgacgtggacatgagtatcgtgtgtttgaattaattttatggtgagaattatttaatttttttttagtaaaagtaaagtaaaaataccctctaaattccaaagtaatactttttttagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttaccttttttattaaaaagtattgatttgaaatattttttgaaaagaaggcactttatgcaacgtgtgcgctaaaattaagtgggctggaatgtttcacgtgatcgagcactacttttttctcgtaaattattaagtgttatataatttaacaaaactgctttaaatataaaattcatgcactgtttttaattacataaacaggttagtgactaatatcttaaccattaaattatcaaataaataaacgatcaaaaaaaattatcaaatcaataaatctattatgtaacttacccattgctgagaaagttattcacttccccacgttagatactcctcctctttctattgttacaaactaatgccaatgcattgtttggcttatacagaaagacagtatttatatttggtagaaagatagtatttacatagaaattgaaaataacgtaaaaaatgataggaatagccctaatccgaataatttatgctgtcgacctgcgtcttctacagggccacaatatgttggcaggatcttttatcaaaattgtcggtggttctgttgcaatttgcaataagtaatgattaataaaattgatgatgtcactggtgtctatgtaatgaaaataggtgaaagttacgtaagatacagagctagacttaccctctgttttggaagaggaaaaaatgaaagaaaaaaaattcaaaatttaaattggaggaaaaattaaaaatagaaaacttgtaatttttttcttctaaaagtgggttactctctttgattttttatattttttctcaaatcaaataagagaaatacatgctttttttcttcttttatttgtgtttcttccaagtggacccttaagctttgtttgagagttaagaagggaagggaaggaaaaagattcaaggggaaaggaggataaggaaaatgagaaaaatgagggaagtttcttgttccttatttaggagttaaaaatatattaagagaaggaaatagagagttaataagatgttaaatgtgaaaattatataatttaaatgtaaaagtatattaaaaatatattttaatatatttttgaatttatagctgggtagaatagtaattttaattacttttccttctaaaaatcccaaattgggggaacaacaatttttagactttggaaaatttcagaggagtcttaaaaatcctcaaatcattttcttcaaaaattaaaacttccaaacaaggagatgtcaccacctaaatattttccttcctttttttttcctctaaaatctctctcccaaacaaagccttattgagtgaaagactttttttttttcttgtgaatgacatatggtgattggtggaagagggcgtaggcaaatttcgaaagccaatagtaaagcattatgcgcaaagaccttcataaaattccataatatatatacattctttgcgtcttatttttatatttttattacatcacattatttactatattttcaactttatttggtaggatgatatatttatcaataagtaactatatgtacctttcgtaaatcattcattttaattttcatattaaaatcatgcttctagaaaatggtgaaagcggagttatattagggagcaatgataacggcatactcttttttcttttcgatgcgtgtatgaataaaaatagtaatcactatttacatcactttgaatcaaagttaattagaacaaataataaataaatttaataataaataaataaataaatgaaagatgaaaggaatgataaataattataaaaagatcatctataatataaagataataacatatttaattcttcattagacatattttttctttatttcatcttaagacatataatccatgaatttatatcacatgtcttatttaactaatttttttcaaataaatttcaatatatttttatctctctttgtgttaaactcttgatcacaaactttattattgttaaatattcaaaaaatgtctcattacaagcacaaaacacaactcaaaataagagagaaaaaatagaagaagaaagagaatgatagatatactaaataatatataatagctaatgaacaatgaagagagaaagaaaagaatagaataaaattaagatggaatatatataagcagtgccacagccatggattacatccacaccaaaacaacaactgaagatatattatggcattctgcatcttcaaacatgttctgtcattattccttctctgcattttcttgcaggaacctaccaatgcccttagaaaggctagtaagcttttgccttttagttcccccgttacggttttcaataaagaatctgatggagttttgccatcatctcttcaagttccaactttgagaatttccaaatttatattttgttaattagtgtaccataaaacatttcaccaattgtgtgctttgaattctgtgttttcagacctacattgtgtacatgggaggacattctcatggtccagaccctttgccaagtgatcttgaaacagccacaaactcccatcatgatttactcgcttcttacttaggaaggtaaaacaaatgttaaattctcttaaatattattaggacgtgcgtgttaattaaaatttgataatttaacagtcatgagaaggccaaggaagcaatgatgtactcgtacaataagcacatcaatggctttgctgccctacttgaagaggaagaagcatcacagattgcaagtgagcaaagactattaccatatattgccatgattttcttgtcatcttgaaaccacacaaattgatataataatatattacatgtttttattggtacagaaaatccaaatgtagtttctattttcttgagcaaagagcacaaattgttaactaccaggtcatgggattttcttggactggaaaaaaatgaaaaaattcctgcaaactccgcttggaggaaagcaagatttggagaaaatataatcatcgctaatattgattcaggtatgcttagttaatgcagtttacattttttttttcttcatgaatttgtactgcaaacatattttccttttgtaaatacgttagttgcttcttgaacaggggtttggcccgaacaccccagtttccgcgacaaaggatacggacctgtcccttcaaagtggcgtgggaagggtgtctgtgagatcgacagttttaatggtacaaagagttatctatgtaacaggtaatttttctgttatttcatttcaaaattgttgggttgagcgtgaaataatatatgtattttaaaacggtgtgatgatcacggccatggaaggtagttattattttatttacagcttaattaatgttttatctgtataattttggctcttattttctctctcttgcaattttaattcatttattgtaaataagttcacaattttactctaatctttagttttatacacttttttttgttttaattaattatattagtttttagttgttaaatgtttaattttcaatcctcaatgttagttaaaatgtaaaaaaaagtatgcaaaattaggattaaattaaaattgtgaattttataaaataagaaattaaaattgagatcaaaatattagattatgattcataggctatcaaaattgtaatttagttattctattatattatgtattttgtgtttattaaggatgtgtttgaaacgaaagaaaaactaccaaagtatactagaatactagatggatagaaatataggtgtacttagtatattatatatgtattttttttaaaaaaaatagattatagatgaatcaaaattataatttaattattctattacttatttttgtgtttattaaggatgtgtttgaagtaaaggaaagagtgtgaaagtatcctagatggatagaaactatagttttagtcaaataagaacactactttttattattaaaataagtataaaaagtgcaataaagatgacaagttaatatacaaagctcttacacaatgactattgtggtttcatatgaaaaagtctattttttataataaaaaaatatatgctctgccctccaaatccatatttcaaatccaaattcagacagggacaataataccccaatcatttttccaagagtcacaagaccaaaataaataaatgagtatcataatagcaagcaagcaattttggagtcttcaactcttctaatacacatccacacagagtttaagtacgtattttggattttttttttttcataacattatatgttttataaaaatttctctgatatttttttaagaaaaaatattttaaactatttattgcttacgtcaagaaaaattcttgaattcgtcgctgctaattgctatcacatgtagccataatattaatattaatataattatgatgaatattcaggaagttgatcggagcaagaatttttctaaaaaatcgggaggccgaagacaagaagattgaccgacggctacgcagcggacgtgacttcgtagggcatggtacacacacactgtcaactgctggtggtaattttgttcgcggtgcaaatgttgaaggtaacggcaatggtactgctaagggaggctccccaaatgctcgtgttgtagcctacaaagcatgctggaataaactcgacccaggagggtgccatgaagcagacattctacaagcatttgattatgccatttatgatggtgttgatgtcatctctgcctccgtgggtgcgtctaatccctataaggaagctttgttaacagatgggatttccataggagcattccatgcagttgccagaaacattgtcgttgtttgctctgctggaaatgatggaccatcgcctttaagtgtcgcaaatgttgcaccctggtccttcaccgttgctgctagcacaatcgacagagaatttatcagcaaaatttctctcaacaacaatcaatccattacggtaagatatatcatctaattatctagacattaatttatttcatgtcggttaaaatatgtttctttttcatataaatataaaaatatttgaaattcatttttacaaaattttctattttctatatgttttttattcttataaaatttgaaatgtattgatttttatctaaacaaaggttttcataaatctaaactatgactttttacattagtcatatatataattaatataaatgtaatatttttttatgtatataattaatgtataatgtgacatatttttttaattatttgtgtacttaatgaatgtaaaaaagtcattcacataaatatggatgtctgaatctttctttataccaaaaactaacacattttaatcttatgagaggagaaaaatttaataaacataaattttaaacatttttatatttgaaaaaaaaaaaacatattttaacctttttttttattttcttaacgtctacataattggaccttacgtacatgtatcatatcagggtgccagtctcaatcgaggcttaccatcttcatcgccatcgaaaaagttctatcaagtgattaattctgtcgacgctagacttcctactgtgtccattgatgatgcgtaagcaccattctttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttatttcccaagcttgctttcaaatattcgtctcatacgtgtgtgtatatatatgtattggttgatgtagtcgtctttgcaaaccgggaacacttgatcctaccaaagtaaagggaaaaatactagtctgccttcgaggcaataagttaacttcagctagcgaggtccaacagggtcatcttgctggtgctgtgtcagtttttgtgctaaatgatgagggaagtggaaatttacttctggccgaggatcatattttaccagctgcaagtataggtggaaaggaaagtcctaatattaaaaacggtacaggcaaccatggcaataacaagtaaaattcatatatcattaaatcccttttaaacgtggtattctatatatatagtatatttgtagcaagtgaagcacttgaatattaatttatatatatgttgttgcagggagattttagcttacttgagtgctgcagaaacacatataggagtaaagccagctccaatcatagctggattctcatccaggggtcccagttccgtgcaaccattgatactaaaggtctataatatatacatttggttaacaacaccaacatgacatgatgattaacttttaattcttacaattaatgattcattagagattaatttgtggctaaccgtaacttgtttcttttttcagcccgacataacagctcctggtgtgagcataattgctgctttttcacaagccgcgggtccgactaatcttgcaacagatagacgtcgggttcttttcaccgtgcaacagggaacttctatgtcttgtcctcatgttgctggcattgcgggtcttctcaaaacatatcatcccaattggagtccagcagctatcaaatctgctattatgactactggtgcgttcattaccaaagtaatatcaatataaaatcttcatccacagcaaatcattggcggcttattaacaccgtactatgctttttattaattccagctacaacactagataatacgaatcaaccgattcagaatgcatttgataagaaagcaactcccttcgaatacggcgccggacacattcagcctaaccctgcaattcaccctggacttgtttatgatttaagcacaaccgattacttgaacttcctatgtgcttctggttacaacgaagctttactcaagttttttggcaatgtgaaatcccattacagttgtcccaagtcttacagaattgaagatttcaactatccttcaattacggtgcatcatcctggctcaaagactattaatgttactcgtacagttacaaatgttgggcctccaagcacgtatgttgtgaatactcactggccgaaggggattaaggttcttgtgcaaccaagttcgttgacttttaagaaaactggagaaaaaaagaagtttcaggttattcttcaggccattggtgtgcctggtcacaacattcctttatttgggaatttgtcttggacagatggcaagcacagagtaactagtcctatcgtagtgctggactcttagaaattaatctcagcattgttatgttatcattgtcattttactttgtttgcttttgttgttttttaggctgtaatataagcgtgctttctgctcatgttgcattcaagtgctttgtccaaaaaaaaataaaaggacaatattattgtgcgtgcatgtaatttggcatatttaaaggattggtttgatagtagagaaacgagaggaaagaaaatataaataattaaatatatatctttttaatgtagagagaaaatgaaaagaaaagttatttttaatataaaatttagtttttcatctctcatttttttttctaattcaaattttaaattttttttccctttcatccgattaaatataacatgagattattgtttctttttcctttttatgaatttggaagtctatgtatgaaaggaaaaattttctgtaaattacacatacttctcttaaacatttcctttatctgccactgatttccatcacatgaaattgaagcactgtccaaaaatgaccatttccttcttaaaccatttatttgatctggagttcacttaactataaacaaaaaaattagaagaaaaatttcaaaaacaaattaagataggcaatgaaaaacatgaataattttttttccacacacatctgcttcccaatccgctcacaatggcaagtttaatacctatataaaattcttcaaaaatggaaatttgttctgtgaaactacaacaacaaacaaaactaacgtcacagtagtttctcagtgtattagattcttctatatatctcgcactccacagataaaccaataagaatacaaccaaatagcaacaacaagccaataacggaactattgaagaacaataaaatttgaaaaacttcaagaacccattgaagaattaaaagaaaccctgtataaaacttcaagaacacggttttgaaggagtgagaaccagatctggattcccgggttgcggcgtccgaaactctgacggcggcgcagcggtgaccgctcctccttcaatcacgctatcgtcctctgctgcggcaactgaaagtcgggacagatcttgattctgcatgctgtttaaaagatggggctgaaagtatcgttaaaaaacataaggatgtcgcataataagtccaaactttgggaaagtttttgtaatttatgcttgttttaaacagaaactaaacgttagacagatagcctatgttccttttgagatggccttagggaggtaaacattgaacatcttagaatcaaaatctcaaattgttcctgttttaaaatggccgaatactttctcttctcttgctgaccaaaaaaaaaaaaaaactttgtcttctcttgtttcattctttttggggtgtcctttcttattatatgacaaaactatccttggaagggtgaaatatatgtaaaaagtacttcgatgtttaagttagatttctgacacagaaaataatgaatgtagtaaatgagcaaataaaataatgtgttattttaaaaattttaatcctttatatacatgtatttatgagcttgcctcttaattgaggggacataatatgaaattatttgataatgttaatatagattatatattattaagataagttaaatttctttatattaatggagtggttgtccagaggatactaaaccatcttaaagagattccaaattgtgacggagagaatactaagtcaggccgaaaacgtgcataagccatggcgaaaaagacacgttagagtatcacaattcataagaaaaaaatattatatttactcttaaatgttcatatatatttatttgtaaaaaatttaagatagattaaaaaatatatatttacaatatgtcaatctaacttaaaatctattaagaattaagatattattttattaaaatttaattaaaatacaccgtcattcatgtatatagatagatattattctatatgataattttttataacaattaatttaaaaattatatatagaatgatattttattgattaatacgatataaaaaaattatatttacggggtatgaaaattatgctcttaaaaataaatatatattttgacttaaatatattttctatttatgtaatatacttttaaacattattcattttgtaaccataaaaaatgctaatatcatactatttaaaatatttttttattaataaaaatttattagaaatcataaaattttgaagcttacgttatatataggaaggaacgtggtagctttgaacgtccaacatattgtacgttaccataatcacccaatagctcaaacatggttttcaccaagccttcattaatttgtttaattctcggttcactcctaagcctcctttcctcccaagttttcacgttttcatcttttggctttgctgccatcactgcttatgaagggacggaagcaagtgctctagttgagtggaaagctagccttgacaaccaaagccaagcttctctgtcttcatggacaagtggcgttgtcagtccttgcaggtggaaaggaatcgtttgtaaccaatccaacgctgtgactgccgtaaatgttacaaatttggggctaaaaggtactcttcacactctcaacttctcttcctttcccaagctgctaactctggatattagtcacaacagttttagtggctcaatccccatttccatgatgaagttggctagcttgtcaattctaaacttggaatacaatagcctttcgggctctattcctgaggagattgcagaattgcagaacttgaagcgtctaatacttcaagggaatcaactttctggtaccattcctccaacaattggaaggttgtccaaccttgttagacttgaattgtccaaaaactctgtctcgggtacaatccccacttcagttacaaacttgacaaatttagaaaaacttcagctctcagtcaatagtctttctggctccattccatcctccataggagacttggtcaatttgactgtttttgaaatcgattataatagaatttcaggttcaattccttccaatattggaaacttaacaaagctggtcagtatggtcattgccattaacatgatttctggatcaattcctacgtccatcggaaacttggtcaatctaaaggatttcgtcctttatgagaacaatatctccggaattattccttccaccattggaaatatgacaaacctcgacgttttcagtgtctttggtaacaaacttgaaggcagattaccaccagcattgaataacattaccaatttgaagttatttcgtccagcagacaatagtttcactggccccttgccacaacaaatttgccttggtgggctacttcaagaatttactgctgaaagtaatcatttcacgggtccagttccaaaaagcctgaaaaattgctccagtcttactagactcagactagatggaaaccagatgaccggagatatatccgatgcttttggtgtatatccaaagttggactacgttgatctgagtagcaataattttcatggccacatttcaccaaactgggcaaagtgtcctaatctcacaagccttatgatgtgcaacaacaatttatctggtggtatacccctagaacttggccaggcgcccaagttagagagacttgttttgtcttcaaatcatctaacaggaaaaattccaaaagaacttgggaagttgacctctttgctttatctatcaataggcgacaatgaacttttgggtaacattcctacagaaataggtgctttgtccggccttgaaaaattggagcttgcagcaaataatttaggtggcccaattccaaaacaggtgggatctttacttaaattaattcacttgaacttgagcaaaaacaaattcacagaaagcattccttgggaatttaacgaattgcaatctcttcaagatcttgatcttagttggaatttgctaaatggagaaataccagcaacacttgcgagtatgcaaagattggaaaagctaaacctctcgcacaacaatctctctggagccattccttattttaagaatagcttggcaaatgttgacatatctaacaaccaattggagggttcaattcctaacattccagcctttcttaatgcttcatttgatgcattgaaaaataataaaggcttgtgtggaaatgcctccggtttggtgccttgccacaccctacctcatggtaaaatgaaaagaaatgtcatcatgttggcattactcctttctttcggcgctctatttctgttattattggtggttggaatttcgttatgtatttgctaccgaagagcaacaaaggccaaaaaggaggaggataaagaagaaaaaagtgaggatcattattccctttggagttatgatggaaaaatggtgtacgaagatatcatggaagccacagaggggtttgatgacaaatatctcattggagaagggggtactgcatctgtctataaggcaagattaccctcgggacagattgttgctgtgaaaaaacttcatgctgcacccaaccaggaaacacccgattcgaaagctttttcagctgaggttaaagccttggccgaaatcaagcaccgtaacattgtgaagtcacttggatattgtttacatccacgcttctcctttttggtttatgagttcatagagggtggtagcttggataaagtactaaccgatgatacgcgtgcatcaatgtttgattgggaaaggagggtgaaggttgttaaaggtgtggcaagtgctttgtaccatatgcatcatggttgctttcctcctattgttcatcgtgacatatcaagcaagaatgttcttatagatttggattatgaagcccgaatctctgacttcggaacagctaaaattctgaatcctgattcacaaaacataacagcgtttgcaggcacatatggatattctgcaccaggttaggccatttttgttcttaagaatttaatcctatatatacttgtttcaataataagtcctgctacttgttttataatactattttgttattattttgatgaattacagagcttgcttatactatggaagtgaaagagaaatgtgatgtcttcagtttcggagtgctttgtttggaaataataatgggaatgcatccaggagatctcatttcttcattgttttcatcaactgcgtctaatatgctattaattcatgtgttggaccagcgactacctcagccagtaaagccaattgtggaagaagtgatcttgattgcaaaattaacatttgcttgcttaagtgagaatccacgctttcgcccaagtatggaacaagtgcataacgagtttgtgatgccaaaatcatcttctttggatccactccccatgatcacacttggtcaactatctaaatagtgttgaaacttgttttcttgtgtgttgtatgttttttagttcttttggtgtacactgtaattaagcttttcgtgatattaatgtttttctcttgcatgttttgtatttctgatggagtgctttgtatgtttctgatgttctgtaaagacttggaaaataatggaaagttgcttatgtcttttgtaaaatcgaataaataaagtgtgattttgaagggagacagtcatgtttttggtctttataaaataaataaagtcactttatataaaaataaatataaaagctactttatcaaaagaaaaaagtaatgtttttcgtaagataaggatattttgactgtctatttctttgagaattatttggcgttaacggttagccactcgatgaagtatattgcatttaattgaagacactcccaagtcgcattatatattaggactttagtaatctacaagaaaactcgtataaggatattttgaagaataaatttgaatacaaatgttatatattttaattttacacaaaactattatacggatcatttcatttttttcaaatagaaaaaaattaagattttttatgactgatatttgcaacaaagtttaatcaattaaatattttattaaatcaaatgtcaattgattaaaattttatttttataaataatgttctattatgaattttaataaataaatgttatatgaaatttacataaaatgagaaattaattaaattaaattaaattagtttgattggttcaaaattaaaagctttattcattattataaaatataagaaattaatatatttaagagactaaaaacatatttaagattaatatatttgtaaaaacaagaaagataataaaaatattttagtaaaattgatttctaataaatactatgatattggagtgattatttttcttagtttacgtggaaaaaaaattatccctaccctattatacatgccatctcgcagttgttacaaaaggaagacgttcctcacaaaaaaaagaaaaagaaaataaaggaagtcgtttctttgggtccaccaaaaaaaagaaagaagtcgtcttttgataaatcaatctacgagtttctgtaccttgttcaaccaatcaatataaaaaaatattactccatttgaaaatttctttagcttagacatgcgtgatgtgcatttcctatactattagaatgtgactcttatcaaaccaacttataaaataagattatttttcatttatataatgtatatcatctcttatcaatgtgatattttttctcaacaataacaaatatattaattgcataaatagtgatatttagatttatatattttcctaaaatatttttagatttgatgtgtggataatatcatatgtaatttttaaatagattcttatattattctaaaatatggatttaaatttaattaaatcatataatattgacttgtaaagtgaaaattattatttccttatatatttatcttgatattatttttatccaatgtatggcttaattttgttcaatatatatgaggcttcattcttgtttattctatatctaatttcattttatttatttattttcaaaccaaagtggtctgattagggatattttttctaaagcaatatttctctatattttttgaagataaataattccccaaaaaaataaaataggctaaatcaaatgcaatatattttttttttttnnnnnnnnnnatattcttgtccaattatatttttaacatataaatttataactaaagcataaaaaaatattcaaacaagaaaaattaaaaaaaaaagcatatataaaatacttcatctacaatcatcattattgtaattaaaaatataaaaatgagaatagtttgaacattattaatttcgacatacaatctaagatatcaaaataatttgaaaaacttaattaaaagaaagtagtccatacatactaaaagacatttaggattatcctatcatataaaggaatttgttataataacttttttttggaacaagtattaagataatattattaaacaccaaattggaataagatgtaccaattnnnnnnnnnnaaaaaaaaaagggaatgccaagttaatgcatttcagacgatgatgttcttatttccttattatttttataataattgctttaaaaatctatatatattcttgtccaattatatttttaacatataaatttataactaaagcataaaaaaatattcaaacaagaaaaattaaaaaaaaaagcatatataaaatacttcatctacatttaatcatcattattgtaattaaaaatataaaaatgagaatagtttgaacattattaatttcgacatacaatctaagatatcaaaatagtttgaaaaacttaattaaaagaaagtactccatacatactaaaagacatttaggattatcctatcatataaaggaatttgttataataacttttttttggaacaagtattaagataatattattaaacaccaaattggaataagatgtaccaatttaggcgtgaaaccaacattacacaacgaggacaccagaattgcataactctacttcctcttaattcacatgatatcagggacaaacattattaataactaccaatacgttcctcttaattcacatgacatcaggggtgaacattattgatcaaactgaatagaaggaatggccttgtatctcattctccttcccctagatacacaaagtaatagtatacacacaaagaaagttgcaatgaagaactcagcaaatcatattagttttcaatagcaatcccccagctgacaaaggcaaagccatcaatcaaacatgtcggttaatcaaatttttgtttgcacggctctgttgacaccaggggcaattatgtcaggctgaaacagaaaataaagtattgaatgtaagaaaatggaaaagaaaaatatatcatgaagatgaaatgaaatgtagaccttgagtatcaatggttgcactgcattgggacccctggatgagaatccagccacaattggagcaggctttattcctaaatatgttcttgctacagtcatgtaagcaacaagtttcctgcagagaaatttatagattaagtttttcatttgctgcaagtatttttacaatgtaagtaacactgaaatgaaattggcttagtgtctgtttgaattcatgtcagatcatccaaaatgaccttgaaataccaactttcctgattttaaataaatatgtacatgcttggtctcccgttggaaaattgattctgaatcccaaattaaacaatttatccggtggtaaaccgccagagcttggccaggcacccaaattacaacaacttcaactctcttcaaataatataagtggaaaaagtccaaaaggttttcgtaaattgaccctgttgtttactctctttgagtcacaatgaattttctaactacattcccacagaaatgggatctttgctaaaccttcaacatttgaaacttgcagcaaatagtctaactggtccaattccaaatcaacttggacgactgctcaagttaattgacttgaatttggcaataataaattatcacatggccttccctctggatttaactaattgcagtctcttcaaactcttgatctttgtgaacttgttaaatggacaaataccagatcacttggaaagttgcacagattggaaaatttgaatctctcacacaataatctctggcaccattccatccaatttttaagaaattgttaagtttgacaaatgtttacaccaacaactaattagagggtccaattcctgataatgttgaaggtcacggctatggtactgctaagggaggctccccaagagcaagcgttgtggcctacaaagcgtgctggcataaactggataccagagggtgccatgaagcagatattctacaagcatttgattatgccatatatgatggttttgatgtcatctctgcctgcctccgtgggtgcgtctaatccctataccgaagctttgttaacagatgggatatccataggggcattccatgcagttgccatgaacatagtcgttgtttcctctgctgggaatgaagggccatcacctttaagtgtcacaaatgttgcaccctggtccttcaccgttgctgccagcacaatagacagggattttctcagcgacatttctctcagcaacaatcaatccattacggtatcatttttctatatttttccgtaatttatcaattagtttcatatgtttttattatgtcaacttaattaattggaatgtgtgtgtatatatcagggtgccagtcttaatcgaggcttgccaccatcgtcaccgtcgaacaagttctatcccataattaattctgttgcggctagacttcctcatgtgtctattaatgatgcgtaagcacaatttttgttttttatttcccaagcttgcttcaaatatttatatgtacttgtcgcatacgtgtgtgttgaaagcatgcaccgaaagcataggtgcggtttttcaataaatgcacagtaaatgttttgaattttcaacccgtatgcaccgaaagtgcacagtaaaatttgttactgtgcacacgcgttttgcaacctatataaagcgctttgcattcggtttaacgcagcaagcagtaagagtagaagaagagaaaatttaggagtgtgtgagagtaaacaccaagtgaggaaaaatacccatttctgtatttttcttttgtatccaattttgtgtgatatccttgtgaggattattgggtatatttgagaattgggttttgagtgttattttttctcttttgtactcttcttcattctagtggaactcttgatctgtctttgcccgtggacgtaggtacactgccgaaccacgttaaatatctgtgtcttgtctgtgttccattttacttcccattttatttttctccatctcatattttgctttatccgatccaattttcgtaacaaactggtatcagagcatactggttggatatatttgggtggaagtactgttcaatcattattcactattcattggcactatttggacggctgtgaacagtgtatagtactattcacgtatacgtacggtacggtactattcacatatacggtacggtactattcatgtatacgacactattcacagaaaaatagtgtgatccggagcagttattatttggagtatcgtcaacactatggcggcaaaatttgagattgagaagtttgatggcaaaattagttttagcctatggagagttaaaatgcgtgctattttggtccaacaaggactacaaaaagcacttttgccaagagaaaaattgtcagctgatgataacgctgcaactgcaagcacaacaactgcaacaaaaatagcgtccgctgcggagttgacagatgttgatgagaaggctcgcagtacaattattctcaacctctcagacaaggtgttatgcgaagtggtggaagaagacactgcacttggtgtgtggcagaagcttgaaagcctctatgcgacaaaatctcttaccaacaggttatacctcaaacaaagtctttacacacttcgaatgaaagaaggtacgcctattaaggaacatgttgatgaatttaatcgggtaattatggatcttagaaatgttgatgttaaaattgatgatgaagatcaagcccttattttattatgttctttacccccttcatatgagcattttgttaccactttgctctatggtaaagactccattagcatggaagatgttaaggcatccttaatttctcaagaattgagaaaaagggtttctagcaataacaccgatgaaattggtgacggtcttattgcgaggggaggagtcaaaataagggaccagtaaatagaggccgatcaaaatctagaccaaagaaaaatattgaatgttactattgccacaagaaagggcacactaagtgggattgtcctaaactgaagagaaataataaatttgacaaaaaggacaataataatgaaagttcttctgttgttgctggagttgtggaggaaaattcctcagatgataatgttctttcagtcactgtttctgattctagctcagaaaatgagtgggttcttgattcgggttgttcctatcacatgtgtccccataaagattggttcaccacttacagaccaataaatggtggaactgtcttaatgggtaataatatgacttgcaaaactattggaataggtacaattcaaattaagatgtttgacggtgttgtgagaactttgacagatgttcggcatgttccagagttgaagaagaacttgatctctttaggtactcttgactcaattggctgtaagttttctgctgaaggtggaacgttaagagtcgtcaaaggtgctctgattgtgatgaaaggaaaaagaagaggtggtctttatttcttgcagggtgatacagtttatggctctgcttcggtgtcctcaatagtagatcctgattctgacactacccttttgtggcatatgcgcttggggcatatgagcgagagaggcttgaccgaattgagcaaacgcggtttgctttgtggccagaaaacaggtaaaattgacttttgtgaaaactgtgtttttggcaagcataaaagggttcaattcggtactggtgtgcataataccaaaggaactttggattacattcattctgatctatggggtccttcacaagttccatctctcagtggtgcaaggtatttactgactttcattgatgattattcccgtaaagtctggatttataccttgaagaataaaaatgatgtgttccagaaattcaaggaatggaaggctatgatagaaaaacagtccggtaaaaaggtgaaacgtttacggactgataacggtttagaattctgttcaggagaatttaatgagttttgcaggaaagaaggcatcgtaagacaccgtacggtcaagggtactccacaacaaaatggagttgcagaacgcatgaacagaactcttttggagagagcacgttgtgtgctctttactgcaggtctgccaaagaagttttgggctgaagcagtcaacacggctagttatttggtgaacaggtctccatcgactgctattgaatgtaagacacctgaggaactatggtcaggtaaacctgctgattattcttgtttaagaatatttggttgtccagcttatgctcatgttagtgaaggaaaattaaagcctagagccaagaagtgtatctttcttggatatggacagggggtgaaaggatacaggttgtggtgtcctgatcctaagtcacccaagtttctaatcagcagggatgtcactttcaatgaatcttttatgcttcatcagaaaaaggattcatttgatacagatacaaattgtagtgaaagtgacaaacatcaggtggagttacaatttgatgcttcggaaacgatgcccgaagcaattacaaatcagcccacagaagaggaggtgcaacatgaggaagcaccaccactgcaacaggacactattgctgctcggagacaacgcaggcagatcaagcccccccagaggtatgcttatgcagatctagttgcttatgctttgactatggcagaatctttcgaagaagatgagccttccaattaccgtgatgccattacaagcaaagaatctgctaaatggactgttgctatgaccgaagagattgagtctcttcacaagaatcagacatgggagctagtcaaaccgccaaagggccaaaagattattggttgcaaatgggtcttcaaaagaaaagaaggaattcccagagttgaaaatgctaggtacaaggcgcgcttagtggcaaaaggctacagtcaaagagaaggtgtggacttcaatgaagttttttcaccagtggtaaaacatacttcaattcgtgttttacttgcattagttgccttgtataatttgtataataacctaggcttttcataaaagaaataaaattttaaaatttataaaattccgtcgcaaaagccttagtaacggatttagcgacagaattagtgacggaattagcgacggatttttagcgatggagtctggcgccaggagcgccagagtggcgccaagagcgccacagatgctggattttggcgccaggagtgccaggatggcgccaagggcgccagatacactgtatgttggcgccaggagcgccaggatggcgccaagggcgccaaatgcactggaaactggcgccaagggcgccacatgtcggtcaggccccctatataaagggatttcacgattttcagaggaattttcactgttcctctttctcctttacaccaggcagccattagagcatcctcggagcttcaaacttccatcataaacccataaaacacctccctatcatctataaacttgattagaacccttgagaagccaaaatccagccttgttggtgagaattgagagagaaacccctttcccttgaggttttacagaaattgagcgttggagaagcaagaagctggtttcagggagacagagcttggggacaagacttctccagcctttctttgttgatttgaggtaagaaacctctgttttaaccgtttaatttgagaaatggggattggatgaatagtaaccaaatattgatagggccggaattaggcttaggttctttagggagatgtaatcaggaggttgttctgagctatatggcatgttgaaattgaaattgtgatgaagtttgagtttggctctgggaaggaagaaatgtgtgtaaatgagcaatgttagggcctgaagtaacttaagtacctttacaaaagttattcataaggccaaataatcggtgaaaacgcgattagatatgtgttttggctgagttgaaccaatgtgggttcttgactttggtacagctttgaagtgagctgtacagagttctaaaggaactctgaggccttgatgagactgaggcagaccattgagggtcaatgtatagcctagtagaaactgggccaagataaaccttaaggtagagaattttgatctgttttgagtggaaggttgtttccttccatataaacggataaatgtcgtttctgatggtttaattcatgcctactgtagggcgtgaagtgcagcttgctggtagagctcaccacgagactaggggagctgattctgaactgagaccaggtaagctcagcgtttttagggaatgtttccctacttatggttcactgtacccaacattgggtaattgttttgatttgaattgtactctgatgcctatcatgttatgatattgatcctgtattgaatattgatgagatgatctgatgatggctggcaactgcatgctagctaaaccctgagatagggtaggtgcttgtgttgttgtactgagatattgcatgttacttgattatgatgatgttgaggcatgaattgattgtgatttgattgttgtaatctgctggccagtagtgtgaggtactatggaccccattgggaatgtgcccttaagtggatgatctcccttgggataatccataggcgtccatgtaaaccctgaatagatgtgcctttaagtagatgatcctattcaggtattgggcggcaagtcctgagtagatgtgcctttcagtagatgatcctactcgggcctgagccctggatagatgtgcccttcagtggatgatcctatccaggcccagtatgtggttgctgttaatatacgatttactgatactgctctaagttttcagcttatgttctgaggttgagaatttaacaaatgctagtgtacttgatgagattttctgtgatataatttctgattccgttatgatatctgtatagtgatgttatgttctgggaagtgaaccagggagagggaaacctctgaaaaccctgagtttactgagataattatctcacccctgcttggggctatgttgcaggtaccgagactaccgtcactgagagatcccaaggcaagaggcctgagatgggatagagtgaagataaccctaggtttagatgactgagcttgctagctcacttttgattattttgggttgtattttgataccctgaggggtcacttgtatattcagaggaacttggcctatataatatgacagagattcaccatatatgtataacagttatgtatattattatgaattatgcttcctttactgttcattttccatgcttgctgcgttactttgatatcgtataatgataatacgccgggtgcacacggggtgttacaatttggagcttgaacagctcgatgttaaaactgcttttcttcatggtgagcttgaagagcaaatttacatgcatcaacctgaaggttttgttgaacagggaaaagaagatcatgtttgtttgttaaataaatcactgtatgggttaaagcaatccccacgacagtggtataagcggtttgattcctttatgattgaacatggttattctagaagcaactatgacagctgtgtgtatttcaggaagctctctgatgattcatttttgtatctgttattatatgtggatgatatgttaattgctgctaacaacatgtcagaaatttctaagttgaaatctcagctcaactcagagtttgagatgaaagacttaggtgcagctcgaaaaattttgggcatggaaattcatcgagaccgtaaagcaggcaagctgtacttatctcaaaagaagtatattgagaaagtacttgagcggttcgggatggaaagttccaagccagtttgtacaccacttgctacgcattttcgcctatcagcgaagttgtcaccacagaccgacgaggagaaggaacacatgtcacgtattccttatgctagtgcagttgaaagtcttatgtatgccatgatttgcactcgccctgatatttcacatgctgttagtgttgtcagcagatatatggaaaacccaggcaaggaacactgcaagcagtgaaatggatacttcgatatttgcggggtacttcagatgttggtctggtcttcgatcgtagcaatattaacacttctgaaagtgttgttggttttgtggactcagattatgctggagatttggacaagaggcgatctttgacaggttatattttcactctctcaggatgtgccgttagctggaaagcaactttgcagtcaaccgttgctctttcaactactgaggcagaatatatggcgctaactgaggcagtgaaagaagccatttggcttcgaggtttggtcactgatttgggcttagaacaaagttcatcagttgtctattgtgatagccagagcgctatacatttgaccaaaaatcaaatgtatcatgaacggaccaaacatattgatgtcagatatcactttatcagaaatattatatctgatggatctgtcaagattgagaagattgccacaacagataatccagcagacatgatgacaaagcccatcacgacaatcaagttcaatcattgctcgaacttggttggcgttcgtaagacataatcctttattaggatttcttggagaagactgtatcagaaattttattgaagtggagttcagctcattgctttatccccatatctgctggagggggagatttgttgaaagcatgcaccgaaagcataggtgcggtttttcaataaatgcacagtaaatgttttgaattttcaacgcgtatgcaccgaaagtgcacagtaaaatttgttactgtgcacacgcgttttgcaacctatataaagcgctttgcattcggtttaacgcagcaagcagcaagagtagaagaagagaaaatttaggagtgtgtgagagtaaacaccaagtgaggaaaaatacccatttctgtatttttcttttgtatccaattttgtgtgatatccttgtgaggattattgggtgtatttgagaattgggttttgagtgttatttttcctcttttgtactcttcttcattctagtggaactcttgatctgtcttcgcccgtggacgtaggcacactgtcgaaccacgttaaatatctgtgtcttgtctgtgttccattttacttcccattttatttttctccatctcatattttgctttatccgatccaattttcgtaacagtgtgtatgtatgtatgtttgttggtgtagtcgtctttgcaaagcgggaacacttgatcctagaaaagtaagggggaatatactagtatgccttcgaggtgataaattaacttctgttagtgagggccaacagggtgctcttgctggtgctgtggcagtttttgtgcaaaatgatgagcaaagtggaaatttacttctggtcgagaatcatgtattacctgctgcaacccataatgaaagtccagcagatgctgtcaagtttaaacatcagcagcaagtaactaaagttcatatatatatatatatatatatatatataaacacttaatttctacatgtattgttgcaggggggtattaacttgcttgagagcggcaagaacatatataggagtaaagccagctccaataatagctggattctcatccaggggtcccagttccgtgcaaacattgatactaaaggtctaaatacattttgttacaccaacatgacatgatgattttcgttcttacaattaatgactcatgtaagataaacttgcaataatgtgtttctttttcagccagacataactgttcctgttgtgaacataattgcagcttttacacaaggagcaggtccgtctaatattgcatcagatagacgtcgatctcttttcaatgtgcaacatggaacttctatggcttgttctcatgtcgctggcatcacgggtcttctcaaaacatatcatcctacttggagtccagcagctatcaaatgttaataaatcggattccatcggacagaacaataacaacagataaaggaaattgaaagcaataaatggacacaaatattttacgtggaaaaaccctgaggtaaaaaacccacggacaagagtagaaaaaatttcactataggaactccaacactacaaccttcctttttcacaagaagagaacaattttatctctctcttgaactaaggaatactcctcacaaaattatactcaagaataatattataacaaataatattataagagaagagaagaagattttggtgtgaaaaatatgaaggaagggggtctttatttataacccccaatcttcctcccttggcttgttcccaccgatgtgggacttgcctccaacaatctcccacttggagatatgattgagaatcaatcaatctccacactgctctttctctcttgccatctccatattgtctacgtctctgccaggccatatgaagatctgcaccaaatgaacttgtcagtgttgattgattttgtcagcgcatctgctatattctcctttgtatgaatcttttgcacatccacgcttccatcttctaccacttcacgaacaaaatgatattgaactcctatgtgctttgtcctgaaatgaaaggctggattccttgcaatgtgcaaggcactctgactgtcacaatacaagataatgttttctagtttgtgcccgagttcctccatgatccttcttaaccatattgcttctttacaagcttgagtcattgccatatactcagcttctgtcgtagaaagtgccatgactgactgtagtttggaaatccaactaacagctcctcctgcaactgtaaacacatagcccgtggtagattttcttttctccagatctcctacaaaatcagcatcaacataccctctgacagtatattcagatcctccataacatagaccaacatctgaggttcctttgacgtatctaagaatcctcttaacagcattccaatgctctctaccaggatttgccatgaatcgactgaccactcccactgcatgagcaatgtctggtcttgtacaaatcatagcaaacattaaactccctactgctgatgcatacggtactcgagacatctccgtcctctctgcttcattgctaggactcatacttgaggataacttgaaattaacaggaataggggtagaaattggcttacaatcttgcatgttgaagcgtcgcaagatcttcttcaaataattcttttgtgatagccaaattttcctgttatttctgtctcggtgaatttgcatccctagaatcttgtttgctggtcccaagtccttcatttcaaactccctagccaaatgtgcctttaattcttgaatcagatcattgttggggcctgtcaccaacatgtcatcaacatacaacagcaagataatgaaatcattatttccaaacctcttgaaataagcacaagggtctgaactgagtctgttgtattcaaggcttaatatgaaggaatcaaatctcttataccaacacctcggcgcctgtttgagaccgtatagagatttgttcaacctgcaaaccaagttctccttatttggttcttcaaaaccttctggttggagcatataaatttcttcttcaagatctccatgaagaaatgcagtctttacatctaactgctctaaatgtaagttgaatgttgcacacatagccaatacaatacgaattgtagtgagacgaaccacaggtgaaaatatttcattaaaatcaataccttctttctgagcataacctttcaccaccaaccttgcatgataccgctccacttgatcatcactgcttcgtttgatcttgtaaacccatttgtttccaatgggctttcttccttgtggtagtggcacaagctcccaagtcttgttcttatgaagagcttcaatttcttcctgcattgctgtcatccacaatgatgcatccgagctagttgttgcttcttggaacattgatggctctccatcttctgttagaagacagtatgcaatattgccctccataacataatcagtctgccaagttggtgttttcttctcacgagttgaccgtcgaacttctacagtttcagactcaactggttcttcctcctcgtgttctgttgttatttcagaagagacttgttgtccagattcgtctttcacctgaatcgtcaatgtttctgaattattagctaaagtgctacttacatctttcttttgcagcttatcttctgcaaatagtacatctctgctgatgacaacactgcgggcagtaggatcccacagtcgataccccttaactccatcagcataccctaagaatctgcattttctggattttggatccagctttgtgacttcttgggtgttgtacatcacgaacacaggactcccaaatgtatgtaggtgtgaataatcaactggcttaccagtccacatttccatcggtgtctttagatcaatcgcagttgacggtgagcgattaatcacataacaggcagtgttgactgcttcggcccagaatgactttgccatacttgcagttctcaacatagctctagtcttttcgagtagagttctgttcatccgctctgccactccattctgttgcggagtgtatgccaccgtgaattgccttttgatgccttcctgattacaaaaggcattaaattcatcacctgtatattctccaccattgtctgtcctgagacacttaatcttcttctctgtctctaattctatttgcgctttgaatgtcttgaagactgaagatacatctgccttcctcttgattggatacacccaacatctcctggaataatcatcaataaaggacacaaagtattttgctcctcccagggacataactggtgcttgccatacatcagagtgaattaattctagaatatttttacttctagaattagatgcagtaaacttcaatctgtgttgcttacttgtaacacaatgctcacaaaagggtaaagatacctttgtgagaccagggagtagtttcctctcagctagaattttcaacccttgttctgatatgtggcccaatttgcgatgccacatctttgttaagtcttcctcagaactggttgatgcaacagatgtttctgcctccagatacgtctctcccataagcctgtacaagtttgctgcaatcctttcagccttcattactacaagcgcacctttgacaattttcatcactccgttttgaatacgggttatacagtcattttcatcaaattgccctaaagacaatagatttttcttcaagcccttcacatgccgcacattttggattgtgcgaatcattccatcatacatcttcattttgatggtgccaattccagcaatctccaaggcatgatcatttcccatgtacacaaaccctccagaaattggtttatatgaatgaaaccaatctctccgagaagtcatatgccatgttgctcctgaatccattatccatgaatcagcaagctccaatctatccttagacaccgttactgcttcactgtataaaacacttgtattggcaacacatccttgaaaagttgatgcttctgaggttttgtctccaccactccttaaacgacactcacttttatagtgtcctttcttgccacagttgtagcacttgacatgtttcttactcctagactttgaccttccttgtttgtgactcccactggaaccacattccattgaccgtcctcttgtcattgacaaggcttccgcttgatgagaacttgccagcctttcttctttgctccttcgccggctttcctcttcaagaactgcagcagcaacatcgtcgaacactagagattcagtgttattggtgatgttgatgatgagttggtcatatgaatctggaagactttggagtagaatctcagcacgttctgatacttcaaccgtatgttccaacgatgaaagttgagaacatagagaggttagagtattgatgtgctctgtcactgaagtagattcagacatccgaagtgtgtagagcttccttttcagaaatattttgttgtgaagtgattttgatgagtataactttgtgaggtaatcccatatctccttggctgtttccttttcctctatccctgacaatatatcatctgaaagagataggtgcagatcagaaatggccatattatcaattttcttccactcgtcatctgagtatcttgctggccgagcactgatggcctccaaacaattatctttggtcagcaatgccttcatcttcaatttccacaacgagaactttgtcccgtcaaatttgtcaatatctacctttgttgccatggttctatcacgaactgcttttgctgcaaagtaactcccactgcttcacttcggtctccttcaaccagtattttggaaagtgcaccaggaaagtttccaggaaagattggaggggtcactagtggtcccacttaatacccaatctcattagactgtttcgtctttgtgacaaaactttccacacacactttatcacccaaaatacctctccagaggaatgctccgattgcgaacagtaactgtatacagctatagtcactgtataacacctgcaacacctcagtataaatttatactgatatcaacccaacaacttccaaggataattcttttctggtgtgacagatcagtctaagctgcagccacagagcatactaagaaaaaaccttggctctaataccactgttaataaatcggattccatcggacagaacaataacaacagataaaggaaattgaaagcgataaatggacacaaatattttacgtgggaaaaccctgaggtaaaaaacccacggacaagagttgaaaaaatttcactatgggaactccaacactacaaccttcctttttcacaagaagagaataattttatctctctcttgaactaaggaatactcctcacaaaattatacttaagaataatattataacaaataatattataagagaagagaagaagattttggtgtgaaaaatatgaaggaagggggtctttatttataacccccaatcttcttcccttggcttgttcccactgatgtgggacttgcctccaacatcaaatcagctattatgaccattggtactaataattgctatttatatgtaaattctcaatttaaattatataataattattttttttcttcttttaatatttcttttgaaatatataaatttagtttttttaacttttatccaataaatactaaaattagttgatttttagtgtatcgattgtattttttttatataattacacattaaaaatttgaaagatgaattgaggatatggacttagtgcatcaccaatataaaaaaaaagtccaattaaacaagttttgattgtaaaaaggggagcataggaaaatcatcgaaagtcaaaaatctaagacacaaaaaagagaaaaattcacactgaaaaagttgacttatatctcttatttaatggatcttcttacattttctttcattaattattttttccttttatttttgtaagtctctctgacaaagaaagactaaattctacttggagtcgaactatcaaatcagctattgtgaccataggtacattaatattagctatagtaatatatatgcatttttaattacaaaatactatcatatgtatgcagcatatcatttggaaaaacattggaggcttattaattaacaactatgctttttatttatttcagctacaacattagataacacgaatcaaccaattcggaatgcatttgataagaaagcaacccccttcgaatacgtcgccggacaaattcagcctaaccttgcaattgaccctggactcgtttacgatttacgcaccaccgattacttgaacttcttatgtgcttctggttacaaccaagctttagtcaagttgtttgccaatttgaaattcccttatagttttcccaagtcttacagaattgaagatttcaacaatccttcaattacggtgcatcatcctggctcaaagactattaatgttacttgtacagttagaaatgttgggcctccaagcacgtatgttgtgaatactcactggccgaagggtattaaggttcttgtccaaccaatttcgttgacttttaagaaaaatggagaaaaaaaacattaccaatttgaagtcatttcgtctaacaagcaatagtttcactggccccttgccacaacaaatttgccttggtgggctacttcaaaaatttactgctgaaagtaatcatttcacgggtccagttccaaaaagcctgaaaaattgctccagtcttactagactcagactagatgaaaaccagatgaccggagatatatccgatgcttttggtgtatatccaaagttgaactacgttgatctgagtagcaataattttcatggccacatttcaccaaactgggcaaagtgtcctaatctcacaagccttatgatgtgcaacaacaatttatctggtggtatacccctagaacttggccaggcgcccaagttagagagacttgttttgtcttcaaatcatctaacaggaaaaattccaaaagaacttgggaagttgacctctttgctttatctatcaataggcgacaatgaacttttgggtaacattcctgggtaacattcctacagaaataggtgctttgtcctgccttgaaaaattggagcttgcagcaaataatttaggtggcccaattccaaaacaggtgggatctttacttaaattacttcacttgaacttgagcaacaacaaattcacagaaagcattccttgggaatttaacgaattgcaatctcttcaagatcttgatcttagttggaatttgctaaatggagaaataccagcagcacttgcgagtatgcaaagattggaaaagctaaacctctcgcacaacaatctctctggagccattcctgattttaagaatagcttggcaaatgttgacatatctaacaaccaattggagggttcaattcctaacattccagcctttcttaatgctccatttgatgcattgaaaaataataaaggcttgtgtggaaatgcctccggtttggtgccttgccacaccctacctcatggtaaaatgaaaagaaatgtcatcatgttggcattactcctttctttcggcgctctatttctgttattattggtggttggaatttcgttatgtatttgctaccgaagagcaacaaaggccaaaaaggaggaggataaagaagaaaaaagtgaggatcattatttcctttggagttatgatggaaaaatggtgtatgaagatatcatggaagccacagaggggtttgatgacaaatatctcattggagatgggggtactgcatctgtctataaggcaagattaccctcgggacagattgttgctgtgaaaaaacttcatgctgcacccaaccaggaaacacccgattcgaaagctttttcagctgaggttaaagccttggccgaaatcaagcaccgtaacattgtgaagtcacttggatattgtttacatccacgcttctcctttttggtttatgagttcatagagggtggtagcttggataaagtactaaccgatgatacgcgtgcaacaatgtttgattgggaaaggagggtgaaggttgttaaaggtgtggcaagtgctttgtaccatatgcatcatggttgctttcctcctattgttcaccgtgacatatcaagcaagaatgttcttatagatttggattatgatgcccgcatctctgacttcggaacagctaaaattctgaatcctgattcacaaaatataacagcgtttgcaggcacatatgggtattctgcaccaggttaggccatttttgttcttaagaatttaatcctatatatatatacttgtttcaataataagtcctgctacctgttttataatagtttttttattattttgatcaattacagagcttgcctatactatggaagtgaatgagaaatgtgatgtcttcagttttggagtgctttgtttggaaataataatgggaatgcatccaggagatctcatttcttcattgttttcatcatctgtgtctaatatgctattaattcatgtgttggaccagcgactacctcagccagtgaagccaattgttgaagaagtgatcttgattgcaaaattgacatttgcttgcttaagtgagaatccacgctgtcgcccaagtatggaacaagtgcataacgagtttgtgatgccaaaatcatcttctttggatccgctccccatgatcacacttggtcaactatctaaatagtgttgaaacttgttttctggtgtgttgtatgttttttagttcttttggtgtacactgtaattaagcttttcgtgatattaatgtttttctcttgtatgttttgtatgtttctgatgttctgtaaagacttggaaaataatggaaatttgctcatgtctttagtaaaatcgaataaataaagtgtgattttgaagggagacagtcatgtttttggtctttataaaatataaataaagtcaccttatataaaaataaatataaaagctactttatcaaaagaaaaaagtaatgtttttcgtaagataaggatattttgactgtatatttctttgagaattatttggcgttaacggttagccactcgatgaagtatattgcatttaattgaagacactcccaagtcccattatatattaggactttagtaatctacaagaaaactcgtataaggatattttgaagaacaaatttgaatacaaatgttatatactttacaaaaaactattatacggatcattttttttaaatagaaaaaaattaagattatttatgactgatatatgcaacaaagtttaatcaattaaacattttattaaatcaaatgtcaattgattaaaatatttatttttataaataatgttctattatgaattttaataactaaatgttatatgaaatttacataaaatgagaaatgaattaaattaaattaagtagtttgattgcttcaaaattaaaagctttattcattattataaaatataagaaattaatatatttaagagactaaaaacatatttaagattaatatatttgtaaaaataagaaagacaataaaaatattttagtaaaattgatttctaataaatactatgatattggagtgattatttttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaaaaaaaaagaaaggaagtcgtttgtttgggtccaccaaaagaaagaaagaagtcgtcttttgataaatctatctaaaggtttttgtgtcttgttcaaccaatcaacctaaggaaaatacaactccatttgtcaatttctttagcttaaacatgcctaatgtacatttctacactattagaatagctaatatgagttttgatataactaaatcttaccaaaccaatttataagattatttttcatttatatattttatattttgtaaatctctaatcaatgtgatattttttttctcaacaataacaaatacattaattgcacaaaaaagtaatgtttagatttatacatcttcctaaaaaaattttggacttgatgtgtagataagatatatgtgaacttaaaatagattttcatattatccttaaatatgggtttaagtttaagtaaatcatataatgtaagcttaattttggaccttatttatctaaaccagaagcaatttgcgattacaactgaaagaggagtcggacttagacgtacctgttccaaaataaacaaggtgatattattgcataagctagaaataatgggaagatgaaggagatgcatgatatggatgcgatgtttcaccaagctggtggagccctcttaagtgttgagagtttcatccttaggatagactttgctgagtttcacttctggatttgcattattttatgggaattgtgacagactccttttttcttttttttaatagacgcattcattaatcattacagagctttgtttgacaaagttttatgtttggagagcctcctccctctcaatttaatactttaacgtttgctatgaatttatccgctaatataaagaacctcttatattattacaaataatgtacatactatttcgaaaattcttcaagatacaaagtgaagtcacacgggattcaggtcttataaaatatatataaaaacgtgtaaagtgaggaagagtgactatcgatgtaccctttactttcactttttattttataatttaaatttttattcactttaaaaaaggcaaaaaatgataataaaggaatgaccaagttaatacgattcacacgatgatgttcttatttctactaaactagtaaagtgacccgtatgacaagtttgaattttgaaaataaatatatctatattatatataaagttgatgatgcacatcttactaaagagtaaaatgattcagtatttatatgttcaacataatcattatattttaaaaaataataataaaacttactattacattaattaataatttcaacttaattataaatttaaatgtaatttatgagaaattctaaataataaaatgatgtaatttctaatatgtttttatagttacaacaattttttttagtctctataannnnnnnnnncattatattaatatataaatattattaaaatacatatttgcatattaattaataatattagtaacaaaagaataaaattgtgaacgagtaaagttagattttgatgtaacagaactttacaaggttaatgggttagaattcagatgtgactttttaaactagttattataaaaattaataattttattatatgagataataataaattaatattttatagcatagaatgtatatttcaattttctaaaaaaattatgacaggtgaagagcaggtaaattcgaactttttttttatatcaaattatgtggtttaataaacttatatattaaattaaatgattttaaaaagtatttatcaaagataagtgattttcacgtttagcattaattgtaattatatttgacgtagaacagtgacatttgcatcaacagtagctaatgtagaaaaaatactttttttttttatattggttgtgattataatgaatattaaaagtcaaaatcatttatcgttcacacataattttcaaaatcatttaatttggttaaaaaaaaggggtaaattctcggctccattaccatcaacggtgtaagaatatgcttctagtttcaagatccttctttgtgtttttggcttccttgtaattttgacttctctatggtagtagtagtggtggggaaggaggggatggtacggtatcccgtaaagccactaacagaaaaagagagaaagtacgtttaacaaaagaaaataaatttgagataaaataaaagcttaaagaaatgttttttttgttatgagaaacttatgaattttgcagctagtccttaataattttttcttgactattgtcattgaaaaatagacaaattttatatttggtcccttgaattttttattttgtattttttcctaccaatgcattacattggttttgttaagtgctccttgaaatatatttttatttgtcttttggcccctaaaatgttttccatcaattggtgacatctcaaattaacaaaatcaatataacaacagagattaaatataaaataaaatattttttaaggatcaaaagtttttgtttttattaaggatgaaatacaaaattgatgaatttttcaataataaaaaattatttgagcattaaataatatttggcatattacatagtttagtttggatgtaccagatttgtattaccaccgcatcatcagatcatttggagtagcgttattgtgtactgtgtatagttgtttcaattgttttaaatattaaaagaaataattacataaaatcaataatcttgttttatatatatatatatatatatatatatgttaatacttattttgatggtttatttaaattaagaattgttcacatcgggaggataccataggaggaaggagtaccttgagattcaactgctctgctctactccccccaatgctaccctaaccatgccagactcaatggttcatggttaggaaaagaatcatttgaactctatagaaataaaaaacttttactaaatagaatgataaatactctctccattgtgatttagataacttttaaacacaattattttttatagttttaacacaactattaaagatatgtaattaatatttcaaattttataaaatatattatgtagcattcttgagaataaacttttatttcgtggaacaaacataaatgcactctaagagtacttcttggaaaagaaaataaatttaatatttcattggttttgtaaaacaacaatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatcaaattaattttaattgattaaaatattttttcttcaaataatggtctactatgaattttcataaatacaattaaacgaaatttaacaaatgaaaaaatcagtcaaattaaatcaagtaaaaagatactgtaattaaacttcgtatagggtaaataaagtattactataatttttgttattatttgatgttaaaaatcattaataagttttttaaaaaattaagatgaaaagctgtattaatctaaagtttattacgtgacattatcgttgataatatttttttaagaaaataataaatagataaggaaattatatgttcgctataaaaaaagagtgatagggtttacttggttgactattgactgtataaactaaagtagtctaaaatctactttcaaaataattcctgaaaagctaactgtttggtttttttagaagtagtcttcttcattttattttttttgaaataattcctgaaaaacttaaagtaaaataggctaaatcaaatgcattacttcaacgcatgcttgcttccttgattccaatcagttagatcactcttgcaactccaatatgaatgtaattaagtagttgaagtgctgttggattgattgaaaatcatctagccccttcttattttcaaccgttggaatgtagtgtgattattatctcaaactcacccaaattgaaccaaattgcaattgattggtttgatggtaaagatttgacctataaaataacaccatttaacaataatatgcatactgcttgaggagacacaaatgaatctaaagtcacatgactatctaaactgatggactgggttaaagtattaggcactttaattgtaaataactggcatgtgcttagtcatgctgccttgtatgcactggttgtatgcaaccaaggttttaaattacggtcaggtcccgttagagtttcattgcagtatttgatgttgtggaaaatttcagataaatgtaactgatgtggctgcgttgattttatactgcagcagaaattgtcattggataccactttttaaaaccttgaataccattttatagtaagagtttgaaaatttttccttttggagagcctcctcttattcgctaatatgaaagcctattcttatccagaatgtaaacattctttagttaaaacttcaagataataagggaagactaattaaggtcttcaagatatacatagtggaagactaagattgatcatgcattcagcttttataagtagactaagtgtaaagtgagaaaggaaagagtattgattgcacctttacttactttcactctttttttatatcacttttaaatttttattcgcttttaaaaagacaaataataataataaaaaaaggaatgcccaagttaatgtatatcagacgatgatgttcttatttctagcgtggtgaccaggccgacaagtttggttttgaaaaataattatatctatattatatataaaattcacgatgcatgtatttttaaatattaaaatgattctctaatgttcaatataatcattatactttaaaatattaatacaacttaatatatattatatagtaattgcagcataaatgtaagtaatgagaaattctaaataataaaattatattacaggaaacaaaggttacaataatataagctaaataatataataaatttatatttaacttcattgagtaatgtctatttaattggtgtttacacgatgtatttacaaattaaaatattagattaataatctatattaatatataaatatattaaaaatatatattaaaattttcatagtactaatcttacttcatgtataattgttggaacctaaatttgaacttttagtagcccaaaccaaaaggtcaaatttgaataggcaaatatgactgaagtaagttcagcagctcttaattctaagaagagaaaaaaaaaaagttcagcagcaaaatggagcaaaataaatcacataaagcccaaacaagatgtttctggtatcaatgggcagaatattaaaaaaatattttgataagtaagctgatgataaggttgttacggtttatcataaggaggccaagtcaaaaaggttggttaatcagattaactgcatcattgtatatatatagcatacaattagaaaagaaaataaacttagctctacataaacttgcatcattgtatgccacacaaaggaaatgtctaaagatcatgaaatttgataaattctgaaactcagtaggtttttcagaagaaaggttgagagccaacatttacaatttagatatgtaggaattctactttatttactatcagccaacatttttactacttgtaataaacataaaaattacaacttttcaatattccagtaatcttaatctacaaaaaaaaaggaaattaaaaacattttcccaaattaaaaaacaattactgacttgaaagacttattcaacaaacgaaaataatacagagactatgttctgattctgcaatcctaaagtaaatattaaacagagttgctgcaaaataagaaacaaaggcccagcaaaatacatcacaaagatccgctggatgcatggatcactgttatatacaatggataacaatttgctgacttaaaaagtcaataacaatagataattaaatcacaagcactgaaagcaataccagtagtacactagcacttcctataattttgaaaaataatacaaggtgacaacattaaagtagctagagaaaacctaaattaggggtttaattatcatagaatttgatcttaaccccacaaaactgtaaggtgaggaatgccaaagctttgtaagacctcaattgggtgacccaaatgcccaataacagatttatgatatgctctatagctattttaaaatttaggtttaagacctatcaggatctcacaaaattaaactgtaagctagagactgtctaagccttataagaagtaaactagtcatatctttattcgacctggaatttgttgcagcccaaacatacacaatgcccaagagggacaccaaaacacccatgcacttcaaggactaccagattagctgatcaattagaattaggattatcttttagttagtttatcttatgttgccatttagacttatcgtaattagaattcagctttgttagtttagattacgataaaagtttatctttaatgcatttgaattctgttaggattagaatttatctttgctgcatttgaattctgttaggattagaatttatctttgctgcatttgaatttgaattctgttaatatctatttattgaagttgaataatcagaaaaggcatagaaattttgtagaaaatctctcttctcctttctgtgatttcctcccatctcaactcttcattcttttctaaattctggttacgtgacagtgctacagaatttcaagaaattaggattaagaacattgtacaattcattaatgtgaatatttttaatcagaaagaaaaagtttcattgatcagttttacgaccgtatgttattacttgttagaattatctttgcatataagctccatacatgattgtgagggtgcctaatacaaacacagctccaatgaaacgatgttcgatacaacattctaataataaaaagcacttaagactttctacctaataacatcaaacacaaacgacaatgataacatttctgagagtaatttctaaggctacaggattacaattggactggttactgtgtgattgccatctgtccaagacaagttcccaaatactggaaaaccacgactaggccaactggttgcctcaagaataacacgaaagctcttcttttctccaattgtcttgaaagccaatgaacttggttgaacaagaaccttaaatccttcaattacgttagctttggcaacatatgtgctatttggagtccccacattggtaactgtacgagtaacacgtatagggttcatccctcgatttgctactgcgatcgaaggatagttgagattttcaatgttgtaagactttggacaattgtaagagcttctatgaaagtatttgagaaaatatgggttgtgatcatgggcacacatgaagttcaagtaatcccttgttctcatatcataaacaagtccagggtccatagcaaggttaggctgaatatgtccagagccataatcaaatggagttgctatctgatcaaaggcgtcccgaattggtaggttgttgttatcttgtgtggtagctacaggaatagcataatttctatcagaattttttttccagaatttaaagtgcaattttttttttcaacatttataacagattttttattttgcatttttagttcctcagatgtcacaagtgtgtgatttgaattttatctcatttatcatgaggttcctctatcctcattctatctaatatttaacaaaattagctaatgtgacatactgacatgacatcttaaaactctatttaattactgatatcatgtctgtttgtcacatctgccaattccgttaagcgaaatgctagcaattatcaattgatgccattgaaatttaaactacaaaaactgaaagattaaaaatacaataaagccttaattatatttttgactaaggtaaaagggtaatcaatgtttcttttggtatatgcatatagatgtattatttttgccaacataccagtagtcataatggctgatttaatagctgccggactccaatcaggatgaagtgttttgagaagacctacgacaccagcaacatgagggcaagacatagaagttccctgttgtatattgaaaggaacacgacgtctatctgatggttgatttgatggacttgcggctagtgaataagccgccaatatgttgacaccaggggcaattatgtcaggctgaaacacaaaacagagtattgaatgtgagaaaatggaaaagaaaaatatatcatgatgatgaaatgaaatgtagaccttgagtatcaatggttgcactgcattgggacccctggatgagaatccagccacaattggagcaggctttattcctaaatatgttcttgctacagtcatgtaagcaacaagtttcctgcagagaaatttatatatgaagtttttcatttgctgcaagtatttttagaatataagtaacactgaaatgaaatggcttagtgtctgtttgaattcatgtcagataatccaaaatgaccttgaaataccaactttcctgattttaaatatatatgtacatgcttggtctcccgttggaaaattgattctgaatcccaaattaaaccattaagtgatatatgattacctgctattgttatcgtcggaacctcctttttcaaaccattcccgttcatcaatatccttatcctgactgacatccacatttgcacctggtatagtataaggctcagctagaagtgaaccgccactttgcttgctattgaccacaaacactcccactgcgccagcattagcagcttcgtaaccctgagctactgatgttgttttatcatgtcgaatgcagatcaatatgtttccctttatttttctaggatcaagtgctcctggcttgcaaagaccactacggtagtaacacactcataagaaacaagaagtaataaaaatctaactaataacgtaaatattcgaagcaagttaggggaatttgagcctacgcatcttgaattgtggcattaggaagtctagcattgacagcatgaaccaatggataaaatttccgtgatggtaagcctctattgagactggctccctgatacatatacatgcaacccaattaaattaaattgatatataatatagttttccacttttccctatatactaatcatatagcaaaaaataaatttgttatttattctgtcattcaatcacaaattgtcatatacaataagtttgttcacttttatattaattatcttacaagttatattaagaatgatttttctaattggttgatggtgcaaaattttttgtataaactgcatatctattaattaaattcttctagttagatataaaagaaaaatgttgttcatgttacctttaggtgatgtttgttaccaagagaaatgttgctgagaaaatccctgtctattgtactagcagcaactgtgaaggaccagggtgccacatttgtgacagttctaggtgcaggtccatcattgccagcagagctaactacgactatatttctagtaactgcatggaatgctcctatggaaaccccatctgtgaagaaagcttcaatataaggattggagccacccacagaggcagaaatgacatcaacaccatcgtatacagcataatcaaatgcttgtagaatatctgcttcatggcagctaccagcatcatttgtagaccaacacactttgtacgccgcaacacgagccttcggggatccaccctttgcagtgccattgccattgccaaagatggttgcaccaggaacaaaattaccagcagcagttgacagggtatgtgtaccgtggccaacaaagtcacgtgcagtgcgttttaagggatcaagtttgccatattgtgcctcgtaagcttcactgaagactcttgctccaatcaacttcctgattcattcatcatcatatagcatagctgtgtattatctatatttctttttcttggtgtatttaacacaccaacatataaaatgcttacataaaaacagatccgcaaaagtcagtggaaatagaaagtgcatattgggcttcatgtatatatacatacacactgtcacatgctgatgcacacacaaatgtgcctgctttatgcatgtactgtcacatgtgctaaggaactttttcatttgcttacaaatgtttttaattaaattttatgtatttattagtagatttagaggtttgaatttataaattcttacaaactactcagattaccctaacgttattaacattttaaaattgcacataaataatcaaagattcaaagttttatttttgtatgataaaagatacaaagttatatatctatgtataagtgtttcatttgacatttaaagacactggttagtgagattaaagagacagacaaaaaatgttaaaaatgacctgttacagaatgttttgtttgaaggtctaaaatggtcaatctgacagaccccgttcccacgccactttgatggcacgggactgtatccattgtcgttgaaacttatgtgttcgggccaaacgcctgttccacaagtaaaacagtcagtaattcacttccaaccacgcgaacatgcgtgcacacacacaaaataacaacttcaacaacaataacaaattaaaatttgattgggggtataagtattatgggttcatttctaaagtatataatagaagtatctgttcttgaaatttaatgaattaaaattataaagtacttcatattaaatgaaaattcatttttttcacatcttaaaaaagtgtgtatacttttgaagtgtggaggaagaaaaaagtgagattgagataattgatatgatgaaaaggaagaaagaaataaagaaaattacaaaataagtataaagattaagatgtaaaaaatgttcaaattaaaaataattttatatccttttatgatatgttcttattattataaaaaaataaatatacttaatgtcttaaaatatataaaataaataaatattttcatttagtaattgggaacattattaattaattcagcacaaaaaaaaaggcatatatattgttaatagggaaaatataaaattaaaggcaatagaaatggaataacacatcttccgatccattacattctttctttggcccaaaaataaataatgtgtaagaaaaaattatagaaaaacatgttgataaactcttatctaataaacaaactcagtttagatatgccatatccaaaatctcttgtattaagagcaactaaaagtttagtgtacctgaatcaaaattagcaatgattgtattttcgccgaagtttccgttccaccaagcggattctgcaggtattcctccatatttttccagcccaagaaagtcccacgacctggtagtgtgcaatttatactctttgctcaagaaaacagaaattacacttgccttttctgcaccaatagatccaaacacatatatgcgtacagcatcaaaatgcgtagttataatttatatgtacggaagatctaaaagaaaccatggtaatcatttattagctcacgtccaatctctgacgcctcttcctcttcaagtagtgcagcaaagccattgatgtgcttattgtacgagtacatgactgcttcctttgctttctcgtggctgtgaaaataataaacaaacaaaaatattttagtcatcaactagctagcgtcacagaataaagattatttttttataccataggattgcatggaatgagagcaagtcctggaggactcagaactcgccctaacacaatagtaaaattgtatattgatgacttatggtaccaaaatatgttagttttttcactgagacaaatctccttcaaagattttaaaggtaggcaaaggttagttggtcccttccaaccaatttttctctatatactaaagttagaattcgaactaatacactagattttatatataccttcctaagactgatgccagtaaatcataatgggaatttgtggctgactcaagatcgcgaagtgaaggacttggaccatgagaatgctctcccaagtatacaatgtaggtctgctaaagagaatcaaatcaaagcataaacatgtgaaaaatagtatatccaacagcaaaatgtgaattttgtagttgaagttatgtgaaattaaacacagagaactgtattagatacttgcctttctaagagcatgtgtgtatggctgcaacatagtgcaaagcattattggtgataggagaagtttgaagagggaggatgcagccatcttcaactggtttaattttctgggagtgctgataacgcgcttccttatataaatattttcaccacgttttattggaggcaaacatggttcttatgccattctttgtccttaattattcccagcaagtacaacgtaattttgaaagggaactgagttaaactcctcttttttattaaaaatgaaggtttgcacggactaggatcacctgtagagtgtacaccggagttcagaaaaattgcacagttctgactcctaacgttgcatccaatttatataatgtaaatatattttctacgttcaaattgtatgaagaaaacgttttttatggcctatattttgtgtagttgtttatacaaatgtagtattcggatccactatttgcttatttggtatgtagttaacagttaaggatacatttgacaaaagaaacccgtatataattgaaaatttagaagtcggctgaatctttataaggtaaaagttaagaattaaaaacccgaaaacatataaagtaattgattgaaagtgtttgttgagtttagctacgctacgacaaaatgatttttagtggcaattaatatttcttttaccgacaataaaaatggctacgaaacgttttaccgacaatatgtcattagcgcgccattgtatcatgcttgggctggaaatagaagtggtccatggcgccaacaaacattaacagtttatttaaacttaaaatatgtaattaaaaatatatttattttacttgtacgccttgagataaatctatctaattttacctggattaattagttgtgaaaaacaacaaataattataaatataatcaattatatgaaataagtttgccaaaattaaaatttgatcctcttatttttctcaatattgtaattttaatcgccctattttaaatagaagtatttaatcctttaatctctcaattttgcttatatttactcgtaacctaatgaagtcaaacatcttggtagccgcggaaaggtttcatgaagggcacctctatttgtcatctcgatctccttgtcatatgagttcaaagttatccaaagtgtgatgagattttattttcttgaataaagggagcttagcagtttcccaaactcaaaaaccacgatggaaaaaacaaaactaatattaacattttagtaaaataaaggaagatgaaatctggaacaacattgaaaacacgaatatatatatatatatatatatatatatataactagtagataatatataaaccaaactttgtcatgggctcatggcatcatcacattgatttacttcatgagaaatgtgatcccattgaaaaacaactcctttctctctgtacgaggtgtgcatctaggtcaaagcatatataacatgcatgagatttatttctagaggagattgatcagggttgttcctgaaaattttttggtctagaatgaagtgaaaagaatggacccttaacacataaatcttttaaaatacaaataatattaaaattaagggatggaaaaaatggacccctaatatataatatttttgaaatacaaataatattaaaactaaggaatgaaaaaaatgggatcctaacacataaaatgagtccctaatacagattttgtttttatttttttaattttttttttacttaatgctatccgtacaaaaaaatttgggtgtgcccgcccagggccggccctgagattgatcgcctaaattaaagagagtcagactctgaagatattacgaatcccccttttccaaacatgttttatttcgtacactctcccagaaatgaagcataggctgcaacaagtgacgattatggtcacgtacgtaagatgcttccacaagcaacttgtttgctatggagattgcatgcactaccttagttaactttgaacctcccaagggcagggttggctcaactaaattttgagagacttttttatttaaataaaatgttacacacatatataacacacacacatatatatatatatatataacatttttatgttaaaaatttaataacaaataaatatttcttttgcctaagtgagggagccttccacgaaaccacctgaaaataaaactagtctctatcaagttttatgttgtgaactaccaattgtttcttatccatgaccaacaaagataatctaagattgtccttgttattttaaatgatgaccgtatcatttttgatgatattgtacttttgtttatgtagcacttgatgatatgatacttgacgaaaattcctcactcagtatttttataatttggatgatatataaagactaaaatataacattccatttggtaagagcaaatcaaaaagagtggattaaaataggatagtgatagagaagagagacatagctagaaaatatgatgaaattttttagtatgagtgcattaaaataaattataattaaagattatcttaaaatatattaatgatgtagtttaataatgtattcataataaaaaatagaaatatgtacgttaacaaatccatatgtaaagagagagcaaaagaacgaataatgtattccaaaagtaactttaaaatgttactctttatcttaatatttttttaaaatttaatagttaaaattagttattcaatataatcattacattttaagaaaataaatgataataatgacagtaattctaaaagactaagaggaattacttttagaataagttaatctctttatatatatatatatatatatatatatatatatatatatatatatatatatatactccttttccgttggagtgcgtaattctagatatttagttaaagaaaaacaaaatagtcgattttctctcctccgtaacaatcgtttttaatggtgtcatgggcacattgcaacgccgatctgcacgtttagtgttctacttatgcgctagcatgtttgagagcgacaacggagaacgaataaaatgagaatttgagtggattcgaattgagtgttgtaaccaatgtatataaactagttgtatataaactgttgagaaaatagcctatagtccatgcattataaaataattttatattattatttaatcacaaatcaaatatatatactaaatttattaatatttacaataattatcttaatagtcacactaaaaatggtttttaaatgattaatactacaaatttttacattgacagtacataattattaaactttaaactatttttgttttggtaagttggattgtgtaggtatttggccaaagcagtggaaaattttttggtatctacctaccaatgcttagttcaatgagaattggtacattatatgaagcgtaccatcaagagtacaacatttaagatgggtttcatagcctctatgatgaaaagagacataatgacattaattttgattgtttggatattcaaaatgaaacaaattaattttatacagtattttaagatgaaatgaactaaaaatccaattttatttaaggtgtgtttgattgtgtttttattttttagattttaaaaactaatttttagtgagaagtgaaggaatatgtaaaagtacaagaaagaacatgaatgacttggaactcaaaatagaaatccaaaataacttgagatgttttggatgggattgatttttatttttaaaaattacttttagttttcaaaaactaaaataaaaaaaaaacatttgatttaaaaaattctaaggatatgtttggttgaggaggaaagaggcgaaataaaaaggtaactgaatctcaaatcttctatattttactttaattcaaaaaatatatattttatttctatcttttaaatcaaacacaccggaaatgaaaccttaatagaaattttgtttgctcgaatttgagcttgtggaaatggatggagtaggtggtgcgactttagccttggaagaatttagacaatggtgatcggagtggtggagcaaatgtggtggtgaccatgaatgagaacatgaacttaagggagctctgacaggagaatcataatggtgtggtgtcacattaaaaactaaaaaataattttaaaaacagttttcaaaaactactttttaccaaccatgttttacttttctaaaacaatcagttctaaaaaaaacatgaaacaaacagggcactgagttctttaccataatttcatatatttattgttctattcattttatctcatttcatttcatccttacactgcttggaaatattgaaagacaaaagaacagaaaaaaaatcataaaataatacctcctctatttggtaattgataaataacaaaatatttatatgtcaaacctttttcttaacatatataactttttatgatttaaaaaattgataacaaacaaaattttattggttggcgaaaagcttaaactttaattatcatacccttgggcaaccttgcctccaaaccacctaaaaactatctaaaattattatactcttttcttcttttccttttctttccttccactttctggaaccaaacaaacccttaataacaccatcacactcctctaaataaaagaagggaagtagactacattaaaaaaaattatatgttgaaggctatcaacttatacatatgcctctagtaaaaaaatactcaaggctttagacagaggaatcgtttcataacatgtggtggcattcaaggcttcaatcatagtcatcatttcatattagtccagctcaacttcagagagtaattttgttgcaaaataaagactatccttggagccaggtatcagcattttttatttttcgttttgggcttgtagcacctttcagtcagcaatttccttttttacctctagtaaatgcaaaacctgctctgctttctattaatgtttgcaaatgaaatatcaagaatcgtacgtaaacaaaaacatgctatatcagaaggacaaagaaaactatacagtaaattcactaaattcagttgttgttcaggcatgaaaatcttggaacagaactcattactcactagcaactagcaattattgcatctagggagcatggaccaaatgcattagaatccactgttggaccaagatttcacatgcggtccacaaaaaaattggatggtagtgttaagggaaagtagcttttgttagtcctaactcatgaatgctggaatgtgcaactccaacaaaatcttacctaccctgatcatcttcattaagatcaagtaggtgggaagaatctattgagattgaatggcaaagtatagaattcttcatttctattatctcctttgaatgttctaaacttcacccaccacggcatccctcgatctttctttgacctttctacctcaagagtgttgtcaagaaacactgccactatcaaacccactgtcggaggtgatgagaataaggtatttaagaatgcattgaactgcaaagatgaaaattttgcattaagagcaagtaaactactaaaaggctattgatgttgacaagtataaagaacaggttaggttacatatcaaaacaaaaattgaaagtacaaatttcttgaaagaagtctaaaaacaaatagcatgatggtaacccgttagttgataaagcataatatagatggctgaggaaaagtaaaactcacccatccagcattagtatgaacaaggccacgtcgtgagggagtccagtattgattgaaaaattgaggaacagatattccaaggaaaagtgtgagtccaatgataataagatttcttatggagttcatgtttgtgaactgaagaaatgatattccaattgaagctgatgaacaagggaaagtaattgtaaatagatgaacaagagaaaatgtattgcaatcaaatctcagttctgattacatgacatacccacaaggccaaagagaatacagtatagtgcagcaaatattgggaagggtatagaagcaaacacagctccaaattttcctacagatgatgacagaaaaagaaaacaaaaaaaactcaggtaagtggaactatcttttctcgtttataatttatcagagtaaaacaatttccatgaataacatgatgaagaactggtttacttctattgtaatccaggctcatcttcgatttgtctctaccaacctaaaatagagaagaatatcataaagccagcagaaatctgaacaactctgcgacttccaactcgggttagtccaaggagtcccacattttccctagaataaacaaccatgatgctcatcaagctactatagaaagatacatggatcatacacaagaagctgatgcagttaaaactcaatgaagagttagacttacacagaaacagtggaaccaatcgctgttccataaagaccatcaagtaagacgccaatcccctggataaaataaacaatcagttccatctctcaatcatatcaacctctacaatatttttaacttttaatgaccggtcacgggattgaagtcttaaaactattcaaattaatacacaggcataagctaggcaattcaataataataaatgacttgtgccttgtaactaacctgccaaccaatgcctcgacttaatacatatgcaggaggtggagtagcaattgctagccgagaggccgccatgtatgcaccagttgactgccacaagtgcatggtcaagatgtcaagacattatagaaaattcactaaaatacaatgagacaatttatggtgattgtaatcagtgttttgtttctttagtcatttttggggcctgagaccccttggtcaaattttaaaatatgaatctgtagtaacaactaacaagtactgggatagaacatacaaacactaactctgcaggtgagacttatgtcaaccagaaaaataaaaacaaaatcaggaaagaaaatagatacctccaccattgagacaataactgctgacatcatggcaaatgaatggccaacagaaaatgtaggtggaccccattggaaaggatatgggaacatgaacctagtacaacaataaaaaacctcagaaatcagcaaaacctttgaacctatcagaagaaattagaacaggttttttcaggtaccatggggcagttgatatcagatttgctctgtctgttctacagctatgttgtgttatgtcaggcttgtgtcggtaagctccactggcggtcaagataacagcatagatccaaacaaaggggacacaaatcaacactggaaaacgttcaaatatagggatatctctaaatggtctcacgtgctttagatactgcaatttatagcaaaattgtttgccttagggaaagaattataatttgatgcaaaccacaattttctagttagagcacttacttgtgacaaaccaattaccaacaacagcattggtataccaatttctacacagtcccccaactgaaaatgaaaataataaagaacattgagtaaatttatgaagatgttatgaaacgtacggcatccatcaagctatagtgagcatggtcaattacaagattctgaagaagaaaatgccatcaatatttgcatgcaacttaagcattatgccactatcaaataattcagaaatattgttagcatgttgaatgaaaggatttttcaacagaaaatgtcaccaatatctgtattatacaaattaagcatatgccgctaccaaataattcataagatgaaaagtagacaaaaccttcaatccatatataatgaaaacaaggatcaaatttcagcattgaaaattggattcacttaaataggtgacaactcggagataggattcaagataagtttcttaaatattattatttatcatcattcagaataaattgctgtcaatagaaagaccatttcgtcacaattttagttgaaatcgtgaaaattaagatggagatttgagccacacctaccacagggaatccacgttgaaataatcctaatccaaccaatccaactacaggtgccatgccaaggggactgaaaaatctggatagaagatcaacaaaacaaaaatgcttcaaaattttaattagaaattgtcaactcataaacatgtcacatgatactagtataccttgaaaagagtccccagacctggctgtaacccaagattatctgaatacttgatgctacaatcaaagctccctgtattgcacgcattgtttttataaatctctgcaaaccaatcacatggaaagatctcttaaaccaaaaataagaaataaatctaactgtgtttctaagaaagtttatataacttatgttgcaccctaataagaaccttatgagaatcacacaacaaaagctagtaattgtaattagagagcctgaggccttataaacctcctaataaaatttcatacttccaatgtggggactcaagtcccatatctttcaattggatcataacatcccaccacgctccacagtcccaaaacccatttgggttggcagtgtactagtcctagaacaacactgcaatgctgatgtcactacctgagtcgcttgtttgcagttgagagacatggtggaaagctttgacaccaactgataagaaccaaatcagtacagaggaaaatatagtgatcaacaaagaacagttggatgtattattcagtaggcttttactctgatcaatgtgatatagaagaagatgaaatacaatgtattagtccacagggtattcgagaaagccaaacgttctcccatgttccaaccttaatttcattccaacctcattctttccctcctactcctatttaacctccccctcccattctaactgctcctaaccaatactgaccaatgaaatacattcaattaaagatcgtaaaatcctctgtgctgtctgtttcaactggtgtacaccctttttattattgatctcctatcaatccccaaattataagtcatcgatccaaaaaaaagtccaaatattctgtggaagtttaaatcataaatgatagcaaaagtattatatgctatgaggaatgctagtaagtagaacatactattattggttgaaatttactgagactcataactcattgaataaggcataggatccataagatttcgtgaatcccaatagatttcaaacaataatatagtctgtgctagaaagagcatgtcaaaaggtatgccgctagcattttctttacactaaatttgaattttataatctgaggctaacctatcatcatttgacagaaaaccagtggattttcattttaaacttcactgacaacctcatactatggatatagcaaagttggtaaaaactaaatattgattttcctggtgatcaataattagcatatctacaactaaaatcccagtgtgtttcactcaagaacaatcgttgaattttgtccagaataataaatccttggttatatgtttaggattgttgtgagtctaaaagctcccatagaggattcagtgctaatagttacatataggtatgcaaggttccaaaatcaacggaggacaaaggattatcattacaaatggttattaaatgtgttacaaatcaaagaaacaatgtatagtttaatgtgctctcaaactactggtgatgaagaaatggaatgaggaaacttacttcatgagagtcactaatttgttgcaagtcagtgatgatataagcaattggatatatatacgcagatgaacctcctccaacgactgtaggcaatctggttccaaaaagcgtttggagaagtgtgttaatgccagctacaaaaagcagagtctgtattacccgtgccttgtcaccctggttatatcagaaccaaaacaccaacaagtaaatataagcaataaatgtgtggcgaaggcaacaattgttttacaaacaagcagaaattcagcatacatcgcttcctcccatggcatgaacaatccatgacggaatcatcacactcgttcccagcatcaatatataattttgaaatgctagtaggatagcttcagctgcaagacaaggtattcacaatgagccaataagaaagagaatgtaaaggaaattggaaacattaatatcccacctcacagtctaaattgcactgctaaagtagatcacaaaaactgaaaactcaaaattactaagagcaaatcaaaccattgattagaatacaagaaaccaagaactttatgccaaatttgtgtgtatcttgggcatagattcttttatgttaaattttcatttgaccttgttatgccaaatttttacaaaacgaaaaaatgtttgagtactaggaggttatataggcggccttaggtgggaatattagagcattagcttcacactaaagcaagtcacatagtaagaaatgcatgataatttcaggtcaatcattttggtagatatcataaaagatactatgcttagagttttaagcctatatattttcttgtaatctgagtgcattataacgagtgtatgaagaaaatatagagaataattggatgtagctcacattgggtgaagcaggataaacactgtgtgttatttttcttctctttctctctttttgttttctagattgttatgcgattgctcagtacctcacctttccccccatttctttctccgttcaccactaaaccaaacttatatctcctccccactagcatagaacttaacttgttattttaacttttaagaatttcttatcttgggtttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgaaatgatcccttagtattattcttgtgagtcattatcatatgaaaatcgaaaggctttaacaactttttttttattcattcttaatttaaagttttgtcatgttgatatatgtatagagtcacgctattacgaacgacacgaataaaaagtgcatgaatttaacatgtaaggccgagattttttttaacataaaatttaatcagagtaggtgctttgtagttcgtagcaacaatttctccaacacataaggtaaaaatggtcgattctcataaattaatatgtaggaccacttattctgaatcgtacgtcattaataagtataatttgttttttcattagccaggccagaagaagtagggtaaagtggtaattacaatataatggtgatgactcatgattgcaagccttcttagaaatagtgatcacaatctcacagcgctaaaggacatgttaaaatgatgatgagaaacagaaattcaatatatctattcaaaaacccagagtgttataaattataatacacattttatgtttaaattaaaaactaacccaagtagaaaaagattaaaacagaaaagttcaagcttcaaagtcgcactctatctaaaatagcgtaaaaatctcaactttttaatccatataaccagaaacaaagtaatatagcctagtctcaaacttttggagtaacgcgttacgcgtacaaaaataacaaaccaaatggaagaaaacccagctcatgcaatggcttcaagacaaaaaaaaaaacaaaaaaacaaaaaaagctttctatcatttcatccatatgggtttgtaactaaagttggagaaactacaaaacgggcaagcttcctctttctttaattttaccccctaatgatcattaagttcaaatccaaatatttaacaagcaccctttttttgcttataaaagaaaaagcacccttgtttcgtcagatggcaacagaaaatgatgaaaaggaatagaaaaaactcttagtaataagagagaaaaacaaattagggagagagagcataccccaaggaggattagagtctaagcagcattcaaggtcctgaagctgttccatagggagatgggtaatgtctgccattgttgtagcttcagaagagaaacaaagaggtgtcgaaagaacaaaaaggaaaggatgatgaggaagaagatgaagaagaattctcaacaaagtaaagtgcaacaataaagtgaaaaaaaaaaaagcataaatatttattagtcaaataatggagagagtgaagtgtgcgtggaagtgtaacgtaacaccctcaattgtgatcgataagctagttattattttttggttttgaaattcgacgtggtttacgaaactagcccttaataaccgtgtatgaatacttgaataggaaagtgtgggggccccacaaattcccaagtgggggtcattgatattcgactatgaagtggaagtgtccttactggggaaaccagcgaagcactgtgcgtcactatggtcccctgatgggactgtacggcacccattgagatgcataataatgttggtcgaaatggtaccttttgtgagtgaataactgtttccatcgtcatcagatgcgtggaatcgttaaattttcaacttaggatttcaaaatgggcatggcaataaaaacatcaatccatgagaatttgtttgatcggaattggatttgggttttatccgactcagtatgtcggttagttctaatatgaagttcaaaagcacacatttacatatgagggagtaaaataacttgttataatttttttttttagtcgattcaatcttataaaattgatcattttggagaaagaaaaatcgaataatttttcattttttgttttttataaaaaaatataacacatttaagataaagaataatatatttttttttatttagaaaatatccaaattttgattcctaaaatgccataaatagttcgaactgtatagcaacaataatcaatttttgctcaaatggtttgtagaggaaccctaccttctctgatccattcaatacgtgcaatttcttttccgtcgatacgtcttgtaatttgtatctgaactccctttgtatccgcctgttcagttaattcaataacttttttcattgctttacgaaacgaaactctattctttaattgtccagctataaattctgcaataatattagggtgtttataagcatttgcaacttttacaatagcaatgtttagttttcgattcacacaattcagttttttttgcatattcgtctgtaattcttcgattttttaataggtttttttataggaaaaaaatagaaaagtatttaataaatttatcattttctctctcttcccgttttgtccttgccgcttcatcattctccttcttggagccatcatcttgcgttatcattggagttatttttgaaaagcgacattttgatttttttttctctttcttttccaacgacgttttgacgcccctttgtttccatcttctctctttatttgtagatttcattcaccattacagattggtgaaatcagatctccactttagacgcgaacccattcaagaaatcagatctgcatttgtttaagattccaaaggcgtggaccgaaaccagatctaataagacgaacaccatgactgctttcttttcaatcgaaagaaataataaaaagcattttttatttttttctttctcattctttcactcaacgactccgtgcaactctccctcccaaaatttgttactttttttgtgagaaatttgttggaagttaatcatctaaattcttaaattttggatttttgcagattgaatttgttggtattttctttttgttcggatgatataatagattaaaatatttgaacgaatggataaaatttgatctttggaatgagaagcaacaaaaagtggtggtggtaactgatagggatgagttgaagcattcttccatttttttatatatatgaaaattgaagaaatcaatagaaaaaatgataatttctactgttgaagagattaagttgaaaatgaaagagaaaagaaaaaaagtaaccgacagaaaacgaacgatgggtgatagggaagagttgaagagagggaagatctttagctattatcaagtcaaaaatcttgtccattaattattttattaataaatctaatgataaattttaatgtttcacccgtgaatatgtgttttaatgctttatattagaattggcctaatttatcctattatgcatatatttgtaattattaataatataattatatataattaatataattaatgtatatatacacacatatatattatgtaattctatttatatatatatatatatatatatataatttttttggtatcattgtccaagaaatcaaaaggctgttgcgtctcccagtggggtgcatgttccagtatgtgttcaaaggattcaagtttcgctgataagttagctagcagtgtcttgtccctctcgtatttgtttaagactcttccagagcctcctgtttttatttctttcttgctgcttcatgatgcagcttccttttaatattttatcattattaaaatatagaataattattttaatagttaactaaataatattataattataatactaattaaataataaaactaaaaattgtgcattaatataaaaatataattcaattcttaaatattcttacaatattgattctttattaatttttataaatattgtttgaattaaaatgtaattgataattaatctataattatttaaaatgtatgaataaataaatttttaaaaagtttgagatggatttcccaaaattgtctctaaaccccataaaagtcgataaagatagaattaggtttcatttttttttccaccttttataaatccaaacgcattcttttataattcgaaattcattctgtcttttacaagaatgggaatggaaagagtttttttagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcattaaaattctgtttctttcttgtttttattatataaattctctctgtcttgatcttaatgtatcgaaaaagatttatatattgatagctttgttaggcatctatcaatttatatattcataaaggcatataaaattcaaatctaaattcacctttgaaattagagaggattggtgatgttactctgtattgataatttatccattatttttattattttttaaaaaaacatcataataagattaaaaaaatagtttaacatagaagatcctcgcacatcttgataaggatggtgaaggttcaattatagaattattaacgcattaggccgacaccatagtccatatatttaatacagtctatcaagatataactataatcaaccatagctcctttttttaagaggatcaaccatagctcttaacctcatcgaaaactacaaatccacacattctaacccctttgtcatatatatataaaaaatgagtccaaataaagtcgaataaaatccataaaacaataaaaacttacaaatgactatcattgtgttaatgtttcccataaccatttattagatgttacaaactaagaaaacaatgcatagttgttgctctcagattgccagtaatgaacaaatggaacgaggaaatatataattttgtaggcagtcagtgataatgtaagcaactggaagagtaaatatgttgatgaacctccaacttttgtaggcaattagttccaaaagtgttcgaagaagtgtgttaatgccagctacaaagagcagaatttgtattaccatgccttatcaccctggttatatgaccaaccaaatcacagtcaataacaagtaaatatccataaaaaatgtgtttcaaaagcaagatttgttttacacgagcagaaattaagcacacatcacttcttctcatggcatgaacaattaatgaaggaatcatgatacttgttcccagcttcaatatataattttgaaatgatggtaggatagcttcacacttcagctgcaagacaaggcattcacaatgagccaacaaagagaatgagaaggaaacattaacatcccgacacagtctaaattgcgctgcaaaagtagagcacgacaagtgaaaactcaaaactacttaaagcaaatcaaaccattgattaaaatctgtgtatcttaggcatggattttttcatgttaaattttcatttgatcttgttatgccaaattttcacataacgtgtaaaaatgtttactactagtaggttttggaggtggccttaggtgggaatagtagagcattaacatcgagttgaagcaagccaccgagtaagggatgcatgacacttttaggttgattgtgctggtaggtatcataaaaggtaacccctatgcattctctttctagctagaatgacctccattgtgcatttaatcctaaattttttaactacatatcttacacatgaatatataaaaattaggtgtaaggttatcttttatgacacctaccaggaacaaccaacccaaaattatactgattttctcatgtagtggctctcttcaacatcaatgttccactatgcccaaagcaatgaacttctcctaattacaattaactcatttggttccggcatcaagttggcttatctcatgatattctacattttctccacctccaaactcaaggtattctttatatatactcaacgattctataaggtatagacacctatgcataacttgtgtcggcatgtcaaacacttgtcaaacatgccttaagcataatagtggcgtgtcggtgagtcggtgtgtctatttgttggcatgtcaagcacttgtcaaacatgctttaagcataatgacgtgtcaatgagtcaaagtgttggtatgtaaaacacttgtcaaacatgttttgagcaaaaaatgtgtgttaatgagttagtgtgttggacactctttaaacaaatacttgtaaagcatgccttgaatacgtgtgggacatcattttacattgatgcaataattttttttaattaaatatagctagaacatgagtcaagaaagtgagttgacacttgctcttaactaaatacttataaatgactctatcatattttattttttgaagaagttaacttatattatattttaagatagtgtgaaacttgacattttgtaagactcattatagaatttaaccagttattttaacttttaaaaaatatgatacatctttttatcttggaatttttttaaagattataatgtgaaataatcccttaatattctttttgttttctttaacggcaaaatttaatattctttttgtgagtcattatcatatggataaaaaaaaaatatgagagactaaaaaaaaatttaatctaaattaagaaactaaaattatattcaagtcacaaatttgtactaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatagactatagacaaagtgtattaacaatttttttatcttatttatcaagtatataagttaaggaaatataatgagaaatttttgctgaaaaatatttaatattgatctttatgcaattaaaagtattgaagaatgtgtatttaatgcttttgaacttatgcacataagatagaaaaatatgtattaaattcatatttatttattcaacatagacaaagtgtaataacatttttttttatcttataaatcaagtatataagttaaggaaatataattagaaattttcgctgaaaatatttaatatttatctttatgtaattaaaaatattgaagtgtatttatttaatttttttgaacttatgcacataagatagaaaaatatgtattaaattcgtattatttattcaacatactatcttatacttatatttgtgcatttttaccaaaaaaatacttttattagatttggtgatggtggtgttgtatttggttgcatgggtgcaagagtgatggtgactcggtaaaggttcagggaggaggtggttgagaaaggaagaagaaggttagaaaggcatattaaaatttttggaggtgcgtcaaggaaaaattggggtgtattaggtagttgtctatattcaattgagttagcccaatttttatacaaaacttggattgaaaacaaaatatatatggacaataaaaaaaccgttatgggtccaaaatataaaaaaaggagtcttgatagttgaccacggttctcttctgtaatctttctgtttcgtattcctcaaaataataaagtttttatatgtttatatttcattataaatatttttttaaataatatgtgtattttaaaagatagataatattaatttacaattttgaataaatttaggatttaaaaaaaataaaatatacttattaaatattgtaattcattgaagtaatctattaaacattttgttgtatacaatatttttaatgtaatttgtatatttatgatcttttcattataattataataacaattattttagtgatgtggctcttgacaatataatattttttgtataaatcatattttcacaataaacaatcttatttaaatcgataggactatcatgaataataaaaaaatttccttttaaatattgatatagttgtatattcaggtttaaacttgaaatcattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaatcaatttttttttaaaaaccgaaaccactttttaaaataagtttaatatttttattataaaaataaaatttttaataattttacatttaaattttgtaagatgacttataaattaattcataactaaatcaagaaaaggacatgtgattttttattgttttgaagttaattttccttcatcttgtttcaagagaaacaaaatggatggtataggggaaagaagagtaagggagcacggactctacgtaatcatgactttgatgaatgctatactcctctaacaagtgttcatattttgttctcaccaaggcatggatgtcatatatgtaaaaacactaatgctgaagttaatataagattatgagtataggtatagaggtgagaaatagagatacaatgttgtgaaattcgttggagagacattgagtggaattcgcttaagattggatttcctttgcataggaacagatcctcttctccaaattgtgaggcttcctttaaatgtatcattgtaatattaattttattttattgtgggattgatttgagaaactttgataaattaatttcttagttagagtaaaaagttgtctaagttacttagaataaaaaatgtggtgtggtgtgatattataaaaaaaatataaaatattataaaacatttagtagagaaactcattaatttctccattagagatgccctaacccctaagttcccgagactctattccaattacaagttaagaagaaaaacttcttagaaataaaagagatcaatttttcatcgtatatttgattatcatttagtgttaaaaaactgctaaagctgtgtagatgtacaagctcatgcagtttagaccctgaactcttagtaataagatacttctgagtctaaaaaattgattactcacacaagtcggctgcaactatacaagcacacaaaatccatgacaaaagcaatcttttttcttctcattggaaactgtataatgttgaagtctacaccttctggaatttctccacaattattaaaatttggattttgaaatctgtaaactaaaaaatatcgaatttcagccatgaagtttcctatttgccaaagatctcgatttggaccacttgtacatgtgatgatagggttgcattggcctacacatacacattgagttagaacttaaaaattgtgctacgaaatgcaccgactgatatatatatatatatatatatagtatctccccaagctcttcacaaagttgggtctgccccgcaattattttttaaatgtaccaacccatttaaaggcagggtcttaacgtgtggaccaattatgaaccaaaccaagttcctcaccgccactttataaacacagtgaattaatgaaggcctaatttgatgtataaactttcattcttctatggttaataaccaaagaatccctacctattttaggtttctaactagaagctaaagtacacttgcactatttaatacattaataagaaattacgaagacttagtctctgctctataaggtgacaatgaggggctggccaacttcaccctgaattggttcacatgtaagagcaagacactgtatttatttaattatatataaaggggttgggataactaaaaaataattgcgagacaggcacaaatatgaactgttttctgttttcgaagatataaaacagtcggtgagcgagtaccatagcacatttctaagttctaggctaacatgattttagcctttagacttacccaatacgaacatgatctcataacatgcatgtatttgtggtccaaaactatatgtttaccaaaaaaacgaaaacttatctgagatttcaaaattcattttttttattgtacagattttcaattcaatgcttaagccggcctggatataaaaatattaaataaattaaactacttatataaataaaagattaatttatgtgttttaatatttttagaaattctctgatctattttttttcttcaaattaaaattaaaatttataattgattttaatttataagaaatttagtccatcttccttattttctttgtttgcaagtgcatgtgtattaaaaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatcagtatcttattattatacaagaaaacaattagtattttaatttttatcatgcttggtaatgtgtgtgtgcaactgacttgttatcagtcaagtctcgtgcactaaactagtaacttaatttatttattcagtgtaaattaagtctccatattaagacttaagttacgccatttacatgtagttgagatggtccgaaatctatagtaacttaatttatttgttcagtggaaagtctccatatcaagaaacttagacgtagttgagatgaccaaaacagaatgtagttcatatcagaacagctgtcaccagtaataaggggataattacgtaaagaatattgtcatgatcaatggtgaaagcttaagggtttatttatggttacgtagtttatatcttgcactatttaatacattaataagaaattgtattaatttaagtatgaaaacaaatgagaaaatgtatttgtgttattttaaaaaaaaaatataataagataaagaaattttccttgttacataataagataaagaatgtaataaataattaaaaaatattaagttaatagaccttttcaactttaagttcctttcgcaatattggttattttacatttataatcaggtgttttttatccaataattcactccatttctcagattctagctagttaaaagtttttttatttctactttttctctaaaatatttaaaaaccaggatttttcttgaatacgtttgattagtttacattattaatgactatatatatgttgtttggctacgaaattttattagttatttgatgtatgctttatttgtatgtttatcatattttgaaatttagttcattattaacaagtaaaaactcacaaaagaaaaataaaagaaatcacaattcccatttttttttctagatttgttagttatttttctgttttatagttattttttcatttttattttttaaataattggtttgtaggccaacctatttaatcggaagctatactgcttatgcaagacagatgcaagaccaaaaatgaagtccatttttttcagttgaattagcttgttaaaaatgagagtcaataatgcagacaaacttcgaacttaatttaaacaggttgaaatgacccctttacataactctatgggagagtagagactaaggccacggttagtacacgtattttcatattttcgtatctatcatttaactctagctaatttaatttctttactaaaaaagaatccaaatatttaatcataaacaataatattattaaaagcatataattatatatgaagattttttttgggtagagaattatgtatgaagattaaagaagcacgcacttataattttaattaacaatattgtattttttgttatcatatgaaccggtcagtagctaatatataatttaattagattttaatccaacactaaatttaattaaacaaaactcaataatactttttaattaagatattattatatgtataattataatgatgatcggcatattttcccacaaaaatagattacctgagtacttgtgcaaaaataactgatggcgtggggggacaattctaaattctaataacctcttgatttctttatactgatggaaacttttttttttttttccagtaactacataaaacaagcataaggaaaacatataaaaaataggacacagattatgatggaaaagtaaatttcttatgtttggtggtcaaagaaagataatcaaatatggtaagtgttttaggtatattttattatttttcattctttgttcctctgcttttttcactctcaatttcaactctatgaaattgaaacattcacaccaccatgatcaagaagcaaaagcttcaagcttccaaccccaaaccatcgaagtcagatcacactcacagtcaaacaaccaaaattccagtccctttcaagcatcttccttcgaatgacaccaatctgttcgaccctatttttgtgatctgatgtgtttctccttttcatgttcatcccattgttcccagaaaggctcctagatcatcaaagattaggttcacggtggctagtcgtggcggaggcgaatggtcgtcgtctttaatatcagcagcgtccactcttggccttcgaaattcataagggatccctttagtaatggcacaatagtaattctatataaataattaaaataatgataatataaagaattataaatacaggaaatacttacggcaatcggttacattttctatgtgcatcatatacacaaaatatttgtccagcctgtacaaaaaaacaaaaacaatataatgatttagtatacagacaactataaattttatttacagttatttaaacacaaattaataataaaataaatttgtttatttttaataattatctaaaaaattatatctatcctaaattccagactagttaatagtgtaatctcttttgtattaacaaaatgtataaattaaactcgtgatttattaggtcatgaaataatcaacagaccggtgctgtgcatgtcatgatctggggaagaaaaaaagacccgattctaagaaaactgaatttgtcacgttttctttgtaagtcttcttcagttcttctactcaaaatgtgatgcgacacgtgatgtttaatgggctgatgcaaacaaaacattcgaaggaacaatgacagcagcgtgggtttgagatttggatcttgcatcatggaatatattttgtcggtgcaggtcaagaagcaaaattaactatcgtatgaagaatatatcatatatgtaatttccgtaactcagtcctgtcttaatcaaggtgaagtgaaatctttcagcttagttgggtgtttttttggtaaagggaaagacaagaaaaatgttagtacaaggaacaggtttaaatgtgcattggtaaaggattagatacatttggtggatctaaaactttgttttaatacaaacaattgaaaataatagatttaaatatataaaattaaagagtataaaatatgaaaatataaaaatatgagaacagtgaattcattaaatatataaaattataggagacaaaatataaaatattagataattacatgtaattttttaaaatgaggaggtatatgtacacaccttcgctataatatagatccgtcattgtttaaataggtaagatttttcatgagtttcttattattattatatataaagagtacataatatgagactcttatgcggtcaaataaaatatgatgataaatgggaattttaaacctagaatattaaatattatttgaatggttatattaagataaaattaaattttaatgtcttatctatattgtttcagtttcatcacttatataattttaaaaaaaaaatactttgaatctttaaaaaatttctataataataaattagttattttagtattttatcatactaatttggttatcttaaaagacacatgataaactataaaaaaaaaatgtcacattaaaaaatgggtgattcaagtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatccttcaattaattgagattctattttaatgtctcttttttattcttgatatcaaattctattaaaggaattttttaaaattaaatgtaattaatagattttaataatattaattaactttctcaattaacataaatattcattaattttatttatatttaaatatggaggaattacaggattctatctagattttctccatattaaaatctttcgaaacttactctgttaatttgtacaccaggggtaatgctgttgacttactagttttattttcaggaacataacctttgaaatgcaattattatgttactttttaccaattcgagagtaattattatgtttctcgtgctgttacccctaatcttgagttgattggtgtaattaagaatcatcatgagcttcgtgtttgttcctagacattttatgcgcgctcattcttatctttcctttcggattacgcgggaatacattggatttaactttattttttttattaatgaaaatttcagttgttaatatttgttcttccgttctcaaactatagtattagtagatggtcaaagctagtgtatcctcattaaaaaaatattaattgatagaatatatttttgattaaaatattcttatttaatcttgttactaaaaccaccattagtaattaatatttcaatagtaaagagtctagagactatatatgctagatggacattcttattgatgaatgattagtgttatcggcttggatacatgtgcctatcttagacagcaataaaaatttaatgcatgactaattgtaaacaaagatataattgaaaaaaaagttgtaaatttaatcttagattcataaaatatcaatagttttaaaataatactaaaatgctaaaatgtctatagtttaggaacgaaaaaatcattaagtattattttaaactacttcctccatctcatatttttagttgtttaattaaggttaatgcccataaaattaagaaatacttaataaagtaaaatattgttatatttttttactaaaatattcttatttaatactatcttatctttgatacttacattactagcagtgagtagtattagataagagtatactagtatttgagggaaaaaaattagactttgaaatttcaaaacagtaaattattttgaaaaagaaaaatagaaagttaaaacaactaaattcataaactctaaaatcaattgagttaatctaataatttttatgagagttttttaagagacatatatttaagacaatggcttacattctaacaccaaaaacaatcttgggaataactccttcattcaaatctgatcaaaatataccctttatctctctaatgaattggatagacaactcattatctttttatttttatttttatgaatagacaactcattatctttttatttttatttttatgaatagacaactcattatctaatcttgcttgtaaataaaatcactcattacctaataaccatttatcaaatgacttcaaaaatcaatcttctcccacactcgaacacctcctagtgaaacaaattaatatccttccactacaatgaagttgatctaaagtagtcaccatccaactatatgcaatttaatatgcatatacaactttgagagcttcaagccacaatcctttttttattcaaccaaaaattgccaccttttttttccaattaagttttaaattgaaccaagagagatttttaaacctaagaccacccttgcactcttttttatacacatcttcacttttaacccaagaaattttcctctttgttctaccctgtagaattttttagctatacaattttttaaaaaacttgcactggtacgtaattttaaaaaaggacaaaaaaatagagataagataatttaacattaacatagatataactattcatctgttgatggacttactaacaataaataatggaaggactaacttggtgagaaaatataattttatagattttttttgtaatttttgtctttcaaaaactaactcgttagcacctcagtttcaaagacaaatttaataatttactctcaaatttttcttataatgtagattgaaaaaccaaaagaaaataactggttaatattttagtgattgcaataattactacaatatcgttatagactatagttaaagttgcttgtgattttgttcctctctccttagttgttgtatcgtattgcagacgaaataaaggtgcgcaaaaagatggggcagagttctcatagactcatactcatgtagaaacatagtgtataacagaaactaacatggttataatcattatcatatcattagtgaacccttgccgatcatatatatataaaaaatcgagcaaaagaaaaaaagagggaagagctagaggaccaacatatattaataatgattaaataacatattgtatgtggatgaaacttgcgtcgcacacattatgggcacgcgcaccataacctccttgcttcttccaaaataatttttataataaccaggatttgtaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgatggccatgtgatgctgatgaatctgtgaacagggtaatgagaataccttgatacctgtgtatgtacatattgtatctgtttgatgatatgatttgagagccatgaaggccagtttatgaaatgtcaattttgatatattatgcatgttagtgaaccagggggaggaaagacctccaaggaccctgagtttactgagattttatctcaccccgtgtgtggggattatgttgcaggtgagacgcagggagaagctgagagatcccagggcaagaggcccatgcagggatagattacatgtataaaccctaggcatagttgatgagagcatgttggctccattcttttgttacttatgcctattgctttgtggttttgtaccctgaggggattatatgtacatttgtgtacagaggatgtattttctttgttacttcaccatgtatgatgtacaactgatgttataatgacgtcatattttgttttgcttccaaactaaattgtttattttgaaaatttctgcgcaaatggatataatggaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggctgctaataggcagacgaatgaggccttgttgaaggctaatgaggaattgatggcagagttgagatctctgcggagagaggatcgagtaccttctccatcacctgcttatgagggcgaaggtagtcgccaccagggtggaggtagccgtcgttctgatgggcctagccaccatagaggggaccggttgtcccaatctgaggttgatgaggatacagctgctagagggaagatgcttattgctttccgcaagcatgatcctccagtgtttcatggagagtatgatcccattgctgctgttagatggctgcaggccttagagaagatcttcactgtgatggagtgcccagaccatcagagacttctctatgccacttacatgctgcagggagatgctcatgagtggtgggttaccacttcagagttgatgagaggccagggtgaggctgttacctggcaggcttttgaggctcagctcttggacagatatttccccagagatgccagagagcagaagcaggccgagttcgagggccttgtccagggacagatgtcagtagatgcgtatttggccaagtttaatgaattggctaaatatgctcatttcaggagggctctacctgattctgaggtacttgcagctaagttccagagaggacttagagagagtattgaggagaagatagctggtagcgggtccagagatctgggcagtctagtgagacagtgccggcaggttgaggacatgatcaggaggcgcagtggtagccagcctacttttcatgtgagacaggagatgaggagacccagtggtccaggcccatctatgaagggcaagggcaaagacttgagagtatcttctccagcagacagattcaagaagggctccagtcagagaaaagtgacacagagaccagattcacgccctaagtgttcgacttgtgggaagaatcattggggagtgtgttccactggtcagcttgtgtgctacagatgtggcaagcatggccactatgctagagagtgtccacaggcaggcggccgggctatagctgctcctgtgatttcagtggcacctactgcaggccgggtttatacagtggatgctagggaggcagccaaagctcctgatttgatcagaggtactattctgattgatgtatttgatgtgagggtcttgtttgactctggagctactcattcttttgttagtgagcgcactgccttaggactgaacatgcctatgttcagacttccttctcctatggaggttaccaccgcctccagagagcagtgtagagtggatatgtgctgcagagatgtgcattttcagtttgagggcagggagtatagtgttgatctgtattgccttgcaatgcctacccttgagattattttgggtatggattggttggccaagtatggcattatgctagattgctgctataagaaggttgtagtgccttcagatggaatcagctcgagttccacatcgtttctcttagtcttgcaggttcgcaaggaactgaagggaggagctcagggctatcttttgctgagtgcagcagaggagaggcagggggtggatatgtcagagattccggtggtaagtgagtttgttgatgtattcccagatgagattacacagcttccgccggatagggggattgagttctccattgacttggttccaggtgtgggacccatatccatagctccttaccgcatatctcctttagagttaaaggagctgaaggtgcagattgaggacttgttgtccaaagagtttattagaccgagtgtgtcaccgtggggagcaccggttctttttgtgaagaagaaggatgggagtatgagattatgtgtggattacaggcagctgaataaggttactattaagaataagtatcctttgcctagaattgatgatttgcttgatcagttgaggggagcctgtgtgttctccaagatagacctgcgatccggatatcaccagattcggattaagcccgaggacataccgaagactgcctttaggtcgaggtatggtcattatgagtatcaggtcattccttttggtttgacgaatgccccggcagtgttcatggattatatgaacagggtgttcagaccgtacttggatcagtttgtggtggtgtttattgatgacatactgatctactccaggacggagacagaacatgccgagcacctcaggattgttctttagacattgaggaatgatcagttgtatgctaaattgtcgaagtgtgagttttggctatcagaggtgaagttccttggtcatgtgatttctgcagctggggtagcagttgatcccagtaagattgaggctgtaatgtcttgggagaggcccgagaatgtttctgagatccgtagttttcttggtttagcaggttactaccggaggttcattcaggggttctcacagatggtgttacctttgacccgccttaccaggaaaggtagcccatttgtttggactcatgaatgtgaggagtgtttcctgagactgaaggaaaagttgaccacagctcccgtattgactcttcctgatcctgagggttgttttgaggtttattgtgatgcttccaagcagggacttggatgtgtgctaatgcaggaaaagagagtggttgcttatgcatccaggcagctgaagccacatgaggagaattatcctacacatgatttagagcttgcagctattgtctttgctctaaaggtgtggaggcattacttgtatggtgctaagttggtggtattcagtgaccacaagagtctcaaatatctctttgatcagaaggagttgaatatgagacagagacgatggatggaattcctcaaagattatgactttgagttgaaataccatccaggcaaggcgaatgttgttgctgatgccttgagcaggaaacatgtgagtgttgcctgtatgatgatctctgactgtgagttgattgagcagtttagagatatgcacctgactgtgacagagggtgctagtggtctcgagttgagagagatcagagttgataatgaattgattcagaggatccgagaggctcagaagcaggatgatactgtgagagacatgcttggtcagcaggatgtttcttgggagactcatgacttggtgatgtaccaagatcggatcgttgtgcctaagggtgagctggtagatgcagttctgtctgaggctcataagggccagtttagcattcatccaggagctaccaagatgtatcaggacctcaggactggtggccagggatgaagagagacatagctgagtatgtgtctaaatgtctggtatgtcagaaggtgaagattgagcatcagagaccgtcaggtttgctacagcctttacagattcctgagtggaaatgggatagcatttccatggattttgtgattgggctaccgaggactcagactggatgtgattccatctgggtgattgttgatagactgaccaagtctgctcatttcttacctgtcaggactgactatactgcagagagattggctcagctatatgtcagagaaattgtcagactgcatggtgttcctgagagtattatcagtgatagagatccgaagttcacttctagattttggagtgcacttcaggaggcttttgggactcagctgaggcttagtacagcttaccacccacagacggatggtcagacagagaggactatccagaccctggaggatatgttgagagcttgtgctttggagcagggcactagatgggatagatatctacctctggtggagttctcgtacaataatagttttcatgctagtttgggcatggcatcgtatgaggcactgtatggccggaggtgcaggactcctgtttgttggacagaggtaggtgagagacagcttcttggacctgagatggttcaggagactactgagcagatccgtttgatcagagataagttgttgaaagctcagagtcgacagaagagttattatgatcacaaacacaggccgttgcagtttgatgagggcgaccatgtgtttctgaggctgtctccagtcactggtgttggacgggcattgggtgtgaggaagcttagtcctagattcattggtccttaccagattctccagagggtagggccagtggcttacaggctagctttgcctccccaattgtcagggctgcatgatgtgttccacgtgtctcagttgaggaagtatgtgtcagatccttcgcacgtggtgaagcctgacactgtgcagattagagagaatctgacctgtcctacacgaccagtgcgaatccttgaccgcacagagaagcagatcagaagtaagaccatttccctagttaaagttcagtgggatggcaggacacctgaggaggcgacttgggaacgagagcaggagctgttgcagctatatcccgagttgattaccaggtatgatcttgaattttgcggtcaaaattcttaaaaaggggggttgaatataataaccaggatttgtaaaaaaaaaaaaaaaaaaaaaaaaaaaaaaaaaaatttgggcctgtgaatagtgccacgctattagcgtgagatgcggcgccgttagcgtgggagacgcgcttaagtggcgcggttagcgcgggttatggcgcggttagcgtgggaatgctccagaaagccatttcttgcgcattcttggcgcggatagcgtgggggatggcgctgttagcgtggaaacgcgggcaggggcctataaaaggccatttttacggatttttgggccaaaactcaaattttcttcttccccgcgcctctttcagccattaacgaccagagaagcttcatatcttctccatacttcatctaaacactttctacccaactaggaaagtgattagaacctcgagatgagctagatcctagtttcaatatcttgaaaagatagcctattggagaaatcccgttctctagggaaaatcctcagagcttggatttttagaagaaagaagtcgttttagaggcgttcaagcttggaaaagctatcctctgaccttcctcaacagtctagaggtaagaaactcgatctttaaccgattgaattgtggaaatgactctggatgagttctgatgaattttgggataaataagtaagttagggtcgaaactaggcttggactctttagagatatatgctcaggaggctgtttagatgaatgttgagctttgaatcttgagtattaataaagtttagttttgactctgacatctgtgtgagtaggaagattgatgatataatgatgagtttgagcctaggtacttttacaaaagatgttcaggaggctaaataaacggtgaatatgtgttgaaatagccgttctgataaacttgtcaagtatggatatttggcctggttaaggcaaatgaatcctttgaattggctcatacagagtcttgtaggaactctagtgcgttgaataggccgagatagatcctgttgagggtctgtgaatcgcctttgaggtgattagtcctaataaccttaagatagaacagagaggtttaataaaaaggattagctttgttttatcattctaacggttgaggaccgttattgatgtttacatgctcttgtgtagggcgtgattctgacatcactagtgattgtgaccacgaagccgggagagccggtgtagcgctgagagcaggtaagctccttgttcttgggagtgattcctttcctttgtgttccaccatactccgaggaagtattggttgttgaataacatgttgcatgaatattgaaattgaatgttactgattgtgaatgaagcatgtatatatacatatatgtgtagatatctgagtaaatgatatactgtgggcgattgagatgatgttgaatgagatatacactaggtacacgtgttagtgataacctctatgaggtatatgcggtgatagtatcttgtgtttgtagagaattctctggccagtagaatgggttagatatggacttcccttagagccaaagttatatggaacaactctaagtgatcaataagtaatgtgtgataaaacctgagagtatgcgcatgattgcagatgagcatctcttggaagtgtcatatatgtccgaggttgttctgagataaagtacctgattgcagatgagcttttctcaggaagtataatatagatatatgtgtgattaaatccttagagaaggtacctgattgcagatgagcgttctcaaggaatatgatatatctatatctatatctctatatatatatgttgctgtatctgaatagggatatctatgtgatatgtggtgagcaaatgaaagccatgatggctgactaggggtgattatcccttaagttatatatatttatacattttgtctctgtgtgatgaaatgtgatgtgagccgtgatggccatgtgatgctgatgaatctgtgaacagggtaatgagaataccttgatacctgtgtatgtacatattgtatctgtttgatgatatgatttgagagccatgaaggccagtttatgaaatgtcaattttgatatattatgcatgttagtgaaccagggggaggaaagacctccaaggaccctgagtttactgagattttatctcaccccgtgtgtggggattatgttgcaggtgagacgcagggagaagctgagagatcccagggcaagaggcccatgcagggatagattacatgtataaaccctaggcatagttgatgagagcatgttggctccattcttttgttacttatgcctattgctttgtggttttgtaccctgaggggattatatgtacatttgtgtacagaggatgtattttctttgttacttcaccatgtatgatgtacaactgatgttataatgacgtcatattttgttttgcttccaaactaaattgtttattttgaaaatttctgcgcaaatggatataatggaatgttaacaaaccggatgcatacggggcgttacaattttcaaacttctagtttttgcctgaaccaaggcctgctaaacgttatctcttaatggcaggcaaatcgcttttgatataagaaattgaccaactttagccataaaagaaccattttttgctcagcttaaaatttgtgcacattggcatgtgttagctatttacaaagataagaaatagaccaccctctgcatgcacaatgcaacatttatggagcctacttagcaaccctgaattccttagcttggcattctccaagactccaattcgtttacgagttttctaatttacaacttccatgctgtgcaaaatacagccatgcatatcacaaatatgccatttagatagttatataatacctgttctacaagaaatttaaatttaaaataaaaataatgtaggcactaaaattcccattaaagatgtgtgatcaggtgagagagatggatcctctcaacggatcttttgtatataataataaatccacaatactttttttttcaattttattttaaaagttaattgcaaatttaatttttttaagaatttaaggattttttttatttttttttttattttctgaaaataatcttctaccgaaagcaagtcgtagagatttaaacaattcaaactctgtggagttggtacaagtaacgacaggtttgtgtaaattcgatttatcatgacaaaataaaacaaagagaattgaataattcatttattattattagagatgcatccattaatgccattaattacaacattgaataatcaaaataattttttatttatttcatgtctttgaatttgttatgtagaaatattaaataaatacattttacatttaatatattaaaaacgcaaataacgtgtagtatttataagtaatataatatatttaataaatgtattgaatgcttttgacctgtaccttgaacacttttaccccgttattaaagattgaataataaaacttctgagaatatattagttaaaaaatgctaaaatttgaaataaaattttatgaatttatttagcatgtagtgataataattttttacactatcatctattaataaattatcaaatataacaaatttgttactttttattatgaatatttaaaagttacacatgaaatgatttttttttattgattgagagtacataaaacacaatatttattatataaaagaaatatgtaatatttctttaaataattaaaattatttaatagaaactattaaataagagaaattaatcttttgacttaatagcatcatattttaattatattattattattattattactgctgttgttgtaacttatttgaaactgatgaaaagagttgcaagctacacatgcaaggttcctgcaataagtcacaagtaaaaaacggttcttgtaataaatggagagaataggtgccttgaaatcacagtggaattttaacaagagtcaacatagcagggtgttttccttatttgccacacagatggacatccaagtgatgcaaaattcacccttgtgtgcaagaaaacaagtaaaagtggtggtgtgagtttcacgttctaattttgtggggctctcccccaaaatgatccctgcctattttagatacatcgtaggcacatctcaggcttttaaaagacaattcaaacccttcacttgtggtggtgtggtgagacttcacttctttttttttctttttttcttccaatttcccttcactcctaaaaacttttttaggagggaagggggggcaatggaaccacataagaaacaccattttggaacctccaacatccccatgctagtacaacattgttgtcttattatcttcttcatcttcaccttcttcactaccaccaccacccaagcttttgattatgctgatgccctttcaaagagtcttctctactttgaagcacaacgctctgggaggataccctataatcagcgtgtcacttggcgtgaccattctggcctcactgatggcctagaagaaggggtaggtccaaattctcaataatacccacatgacccaactcatcaaattcttgtcttttactctcttggcatgccaattctctttcaaaatcaaaactttttttttctctctttttggtttgtgtaggtggacttggtgggagggtattatgatgcaggggatcatgtgaaattcggtttaccaatggcattcacgatcacaatgctctcatggagtgccatagagtataggcaacaaattgaagatgcaggtgaactagaacacgcattggaggcaatcaaatggggcactgattatttcatcaaagctcacactagcccaaatgtcctatgggctgaggtacactaactacaagaaatttcaagagttttaattggtgttcttctcgagaaggcctttctcaatgtgtccaaattctttccactattagtattgaattaaaaaattaagtgtaccaaaaacttagatttctctgctaccatagcaattttctaattcaatcaatccaattcattattctcactgttttaattacttagaggcattggttgaagagattgaatggaattctaaaattaatgagatactttttttttccaggtgggtgatggtgacactgaccattattgttggcaacgcccagaggacatgacaacttcacggcgagcatttaagatagataagaagaatcctggttcagatctggccggagagactgcagcagccatggcagctgcttccgttgtgttcaggaaaaccaacccacattactctcacttgcttctacaccatgccctgcaggtgagtcattagccaatgctttgtgtcctaattaaaagtgtgattgattgtgctttttttattggctttgacaagctgcatgattaataataattgtctgtagtagcaacttttgtgtgacaatctcaatttcaaaactaataattaggctgactgagattttatttgaaaagtatatgagaaattaaggctaattaataggctttgttaagatattgattaagaaactaataaatagaaaaattttaaattaagattacactgttagagatcacaattgaatggactattacactttctaatgtttttttcttcttctttaatggtgttttgtctttaggacatttattagcatttttgaggaagtattgttgaaatgaaaacatttattgtgtgtgtttttgtagttgtttgagttcggggacaagtataggggaaattatgatgctagtgtgggagtggtaaagagctactatgcgtcggtgagtggatacatggatgagttgttgtgggctgccacgtggctgtacaaggccaccgacaacaaaatgtatcttgagtacgttatttccaatgcgcatgcctttggtggcactggttggtccatttcagaattcagctgggacgttaagcatgctggtcttcaactcatgctctctaaggttacctttagtgtgttttcattttatttaggtttcattgtttcaaactcctttgattttttttcttctcccatgtgagtgtggctctttaatatctatccaactttatctagattttgcttttctaacatgaaaatgatggtgggttaaatcttagtactttattttaaaggtcattcatggagtatgcacgaattaaggtatattaatatactagtattattatctaggggtattaaagacacaagaattaaaaagtgtacccaagcacaaggccatgtgcagttagtgctttagctttgcaacacagcgcagttaaagtggtatggcttatggttgagccgaatgttatagacgtgaagcttgagagccttaaacacctcagtacactctccctccctttttttccccttttaacaaatattagcaaataaattatgaggtagggcagcctttcgtcggctaacatttttagaaactaatttaggtcactatgcattttgttaggaattaatcatatgttaaaaatggaagaaaaaaaagatagaatgttaaagtgtttcacatttataatattgaaaaattaaatgtttatatactttgaaggagtgtcagtaatgtttttttgctaatattttttcaacacatttttcttattggttgaaaatcatgtgagtttcattattttgagaatgagaccatggagaatgagactcatattttgtagtgagtcttacatatgtgtattgcattataatgtcacgtcagtgtttctgttaaaatattaatgttaagttaatagatgaacttttcatgaaaaaaaatagatgatctaaaactacgtatcaaattcataaaaagaaaaaaagttgagggatggaatttgtgagtttagaaggatctaagttcatttttaaaaaatccgaagttttttttttttggttagattaaacccaaagtttacatacgatacttttgagttttgacgcacctttttttggggttgttcatattaaaactgcccttcaaaatatttaatgtgtaacggaagttttttatcttattttatttgggtaaaaaatgtgtgacggaagtcaggctgtgcaggtttctatgttacgagacttttggacaaacttaattaggcttcatattaagtttttatttgtcgtaagtcattagcccaatatacatctttctctttatgcccacatgagttatttttttaattcatcaatggatgtatattcctagcatttatcaactcataatcatatcaaataagtctttattttattttaaattttatttggaatatttacaactatagtttgaaaaagttttaaaattataaatatgcaaattaccttttttgtttttataatacgttcaaatatgtctttgattttttatatatatttgaattttacttttgatttctgataaatttttctttagcatttgttttataatatttaaaaagttttattttagatatttatcttcagttaagtgataaatatttaatataatatataaatttttagaaaccaaataattgtattgaatttttagaaaacttgaatacatcactgatatgtaccaggtgaagtatccaaaactgtatcagtatagaatatgtgaatcaaattgaattctggtctggatactacctatatccaagaatatcatatcggatatataacggatacgtgaaacaaattgaagtatcagtgcttcatatgcagcaagcatatgcaatctaactattgtttcatctgtttttgcagttcttaagggaagaaaaacacaagaagcatagggatatacttgaacaatacaaatcgaaagcagagtactatatttgctcatgtctcaacaaaaataatgatagcaataacgtgaaacgaaccccagctggattaatctatgtccggcagtggaacaacatgcaatacgtttcaacagcagcatttctgctctcaatatactctgatttccttcaaaacacaaatcaaaagctaaattgccatggcggcacagtggaccatgaagaaattcttaattttgcaaagtcacaggttgactacattttggggtccaacccaatgaacatgagctatttagttgggtatggccctaactaccctaaaagggtgcaccatagaggggcatccattgtgtcatacaaaaagaataaagggttcatagggtgtactcaagggtatgataattggtatggtagccaggcacctaatcctaatgttctggttggagctttggttggagggcctgatgggaaagacaattttgaggatcgaaggaacaattttatgcagactgaggcatgcacatataatactgcaccattagttggtgtttttgcaaagttcttgcatatagaaaaccaaaaactggttcatgattgtaattcacttttggttgcctcctttaaataatacaatgaattaaaacagtatatgtttctcataagtcaaaagccaacttttcaatcacttttttctcctcattgatgagtgatttgtggtttggctgagatttttcggcctcaaatgtactcaatataaacaaatatatctatccattcagattgatgatatcagcttgatttgatgatttctcttttttttttttggatgattacatcccattgaacaaataaatgttgccaattaggaagatggaccctaatccaaaagcaatattcagtgaggtacgtatgaaatgggtttggatgacacattttcatttgggctgttatttacattcctcctttttactttctgcattcctgccagtttgttttttcttttaaaacatatccttcataaaagctggtttccataatatagttaattttttattatgtgtttggttttttattttaataaataggcttaattttattttttttaccctcaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaattttgccctaacaaattaaattgacatattttatccctaacttttaagaaaatttgcaaattttattacctatcatttgtccactaataaacacaaaagttggaagaaatttgtttcaaaaaataaaatatttagagataaaatttgccaaaaaataaaaaaattgggtgtaaaattcaccaaaaaaataaaatgaaaattggagacaaaaagtgcaattatgttagaaataaattgacggaggatataatttgtaagtttcttaaaaatttagagtaaaatatgtcattaatttattgggataaattcttaaaaaattgaaagtaaaaactataattaagtctaataattaaataatttgataaattgagaaatagggatgaaaacgttagaccaataaaaataagtcaacatactcatataattaaatatgtcagatacaaaatgatacaattgaaatgaaatacatccaaaaaatacaaagattatttttggattagtgcatatgttatttttggaagacttgtttttgaaaaagcagatgcttttgcttcaataatctttttctgtttaatgatgacaaagaaaactccatggaaatatgggggctcatagcaggatgagggaaaagggatctgcattaggagcaatagttggtaagacagtattgtaaaaccattggaagaatttattctgtctattgatattatacttggatggaatttgtcttgagaaagagcttcttctagtccttcatgatacctttccatttccttcataaagcttactcttcttcgccttcagcatcagaagatgctcttctcttcttgctagagggaggatgtgcatgcgcttcagctttatcttcttcttaaggtttttccaacctcattctctttatactttctttctcagagaaagtgtagtcctcacttacactcttacagagtcaccagtggagacaaatgtcgatgttaaaccactcttcaacatcttccttgcataatagacgccacccacacttctttatttcaggcttacgaggttttgttgcttacgaggtctatttatttataaaatataatagaaaataaaaaatacatattacactaataataataatataatattattaattaaaaaaatttataagaccaatattaaattattatagtcagactagtggtctacaattgataattaatcactaagtctgtagcacactaatacgcctttgttcgcttcaccttctcggtttccagtgcaattttaattgatagctttttatttagttgttggttgcataatacaagatgttatgaattgagcttcaactatcacttaaatgaggcaatttattattacgggtagtaaattaggctttgtttgggagatggattttagagggaaagggaaggaagtgaaacatttaggtagagccatctttttgtttgggagttttaatttttgagggaaaggatttgaggatttttaaaactccactgaaatcctccaaagcttacaaattatagttcccccaatttgggagtttttagaatgaaaagtaattaaaattactatcctatcctaactacacattcaaaaatatattgaaatatatttttaatatatttttacatttaaattatataatgttcacatttaatatcttattaactatccatttcctctcttaatatatttttaacttccaaacaagaaaaaaagaacttccttcatttttctctcttttcttatcctctcttcctcttgaatctctttccttccctcccctcctaactcccaaacaaaaccttagagagtatgttaatgaaacttttattacttattagtctaagtttatgccttagtttttaaaataggttaagcctatttatgtaaaatctagcctgatttgacatgttctcttgtataattctgaccagttgtaatgtattaatgtggtattattttatttatttttgtgtgaaaaagggaaagaaacccagaagaaactatatttttggttttttttatcttggagaaacaaaatatccattttgtctcgctccatgcgttggcttgtttttcatttttcatttcatttgtattttttgtattttctctatttttttatcgcaattggactatgtggtccattttggattttttttctgtttgtttatttgttattttttgaaatgggctcaaacaattttattatggatgttgcttcttgcatttcggaaattccaatcgaaaagttctagccttttattgttgaagaagagagaaacaacaaatttggggctatgctagtccaaatcataataacaatacaaaaacaaataaaaatgaataaaaacagataaaagaaagacggatttaaaagtctataaaagggacccaaattttggtagagtatctttccttaaaaagcaattctaatgaagtaaaattgcatgatatataacacatgttggtaaaaaaaagataagagttttctgtgtcatgcaggtggtgtctaacttcttcttttacttctttatgaaaggcattaatttagcttctgcttcaaacacctcactgcatctcttaactttgtggaaacgcatgaaatcttcagaggaccaatgtcggtgttattactgccactattgcaatattcttccctggttgttgctgataagcgctcttcaacatcttccttgcacaatgcacgccacccacacttttttatttcaagcttacgaggttttggtccttgatgagaatgttcaacaccactacgaggacgagtttcagtagccagcaacaactgaagttggttcttttcacctttcacatcttgccaacagtaatcacgattaataggtaagaacctaacgaatagttgagggcgatctacccaaccttgaacaccatatcccaatttcccaacattctgtgaggccattcatcttctttaggatctttttagaagaccataaaatgctacgttcccacaaattttccgacaccttaccttctaaaacaacacacatgtcacatggcaattcttgaccatgcagtggaacgccaagaattagggatgtttgttactattgatactgctgaatcgaaaccatagtgatttctcgtgtcctcgtcaaaagaaatacttctgttttcaaaccacgatggaacttcactccccggaacctgtaatacgagatgcccctctgaacgctgtatgataaacaaacactatgttactggaaaacaagtaagtattaagtgaaatcagcctacaattaagttaaatccaaagtcataaatgtcacccaaatagaaaactatacaacaatctatggtgcagtatgtcccctcaaaaagtcaaggaatttacatggttaaaattccaccaaagtccaatatatatacttagaagaggtattatagaccaaagagatcaacttcagtgtatcttttgcataagtaacatagaatcaacaaaatattttgcttttctcttgtaatgtttcatacaaccatttggcaaaagagctacatgtgactaggtgcatacatcccattaccatgtttaggtaaaacactatattggtcacatttagggaaggcaaataggagggaggagataaagttctagaaattcatttgaatttgtattatatggtcaatgcgggtgcatagaaaccaaatatactttagttcttatcgatcaactgaacacagatgaagtggtgaaaaaatgataaaggtgaaaagtttgttatgaattaaagcaatgatatggaaaatatatctgtcgtggtggtctaacccattttatgctactacttgagcatacaacgatataataatgggcaacggtactccttgtactccaccatctaatatatttttgtcttataataaaataaaaaatatatcaccatttagtccctaaaaatatataacgccatattaatttttaaaattaaaaaaattctaaataacaccagagtgcaatccatcaatcacgttaattcacacacatatataacttaagagataatattaatatgtatttagggaccaaattaatagtaagcaatttagttggaataattaaaattttcaatgtcttatttatatagaattttcttaatttttaaatattaacaagatagtgtattacgtttttagaaatcaaaaccataccaagtttagtttaaaaataaataaatttgtgagtatgttttttcatcttctttggacaattgctaaatgtaactctcttgttataaaatgcacttccctttatgtaatttgtattttatttccctcaaagttacctcttgtttggaaactaagttgtggaaagtgttaaaaaatttaacacttatgctaaaattgcacccctatctttgctttaaaaaagtagttttcaaaaagtgtaataatactttcaaaaactatttttcagaagtaaaaatgggagttgtatggatctatcaagagagacacaaatgaagtctcttaacattgttgtctttgagtttgtcctctccactttcacaaagcacgtcccctaatgtcaacctattccttacaatttaggagctttgagagacagtggtgttttaggaagtcctactttgggtctctcttgacaaatttataaaactactcctaattttgctttcgaaaagtaaattccagaaaatattataacatttttagaaagtagtttctgaaaattaattttaggaagtcttaaaatgttagccacttttcagaatttagttttcagaaagaaatcattttgaggaaagaaaaaacataaaggaagtacaattagcaaatatgagaagtgcattaagtgaatttcgttggttttggtatttgatagcgaggagaatcatggttgacaagcattgccaaaattttgtgcctcttaaacgaatatgtataaaaattgataatatcaaagtacagtaaaagatgtttcatgttgaatagaaaatgcacgaacgaatgattgaataattatttaaacaaggtacatcgtattcaaaattattattgatgtataaaccataaagaattaactatctattttactattttaaatataaattcacgtgccttttacgtacaaaatcattagggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggattcacgtggcccttcctcttcctctaatccaagttatctatctgttcttgcccaacttatcacaaataaaatccaaatctatccaaaactccactcagtcacaacatataatacaagcaaacaaactagatgaacagttgcttctctcaatcaataaaaaagtaaatgaacaaaagataccctcaattatggaggctctggccattaaagagagggtagaaatatgcaattctgtctggtaactgttgaaaatgataacattggatttgtttcattgcataatgtccagatttctcgcctttgaggtgcttttggaggacatgggataaatgggttccaggtttggtcagtggtcaactacagtcaacacaaattccaacatttatcaatcagtgcggctcataaagttgcttcactgtggacactggtcatggtagtaaaagctttgtcaaatgtgtatgaatgaattaccttattagacattgctatttgcttcatggattctgtttttccaatgggtagacctcaatattataaatactctactaacatcatttttttttatcacattattatcatttctcatatttatatatttttaattttttttccttttctcttttgaggccaataattaatatcataatgtatgtgcattatctttctttttaaaaatatatcaatgaaatttaattcaattagttgagtaaataatgtacataaattattatttaaaaaaataatacttaaatccaattcttttacacatattagtcttaatttattatttaagtatattaataaatcataaattaagaatattttaatttttatgtacattacaattttaaacaataaaatataacttaaaatatgatttttaaaataattattttaaaaattaataaacatattataagtaatatatatgataaataataacatatggttagataatagtattttactgttaaaaattatataaattattaagattattttgattaagattatgttaattcgactaaaactaaattttaaacttttaagtaacattaaattttgtaattaagaaaaatttggttaagaagtaaaattttattaaaatagcttaattgtcgaataaatatttatcaataaaaattaatcattaatcaaattaaaaaaatatattacatctataatataataaaagaaaaaaatgtttttgtctttctagtttgtaaaattcctatagtacttcacattcaaatattttggtctctaaatttttaaaaattaataaaaatatttatttctcaaaattagggatcaaacctgacagtgaagtaaaaaaactaaaacaaagaatcttacaaagaatagggattaaaaatatatatttttcttttaaaaaaacttaatttccaaactaatattatttttacagaaaaatattgacttttgacgatctcttgcagcaaaaaggaagctttttgtcttaaaaaaattacgtatatttatttccagatttgaaaaatgtttcattgaattctcttcacttttatttatttattttttttatcgggaagtgtataaaaaaagagaaaagaaatgcattatataacaaccgaaagtttcattttgtgtctgccatttgtctcacatcctaagaaagttccctttttatgatctctttgaaagaattggattcgaagttgtgatttttgcgcaaatgggtatcgatcaacgtcggtggcggcggcggtggtggaacgccgtcgttttgattggaatggtcggcgttacagtagtaaccgttaccggttccgacagtcaccagaagcaaaaacaagtggtgtctcgaattgccttcggatcatgctccgaccagagcgctcctcaggttccaaaaaaatttctattttgttatgcttttttttttttttctattttaatttttctactttttattctagttctgttttgttttgtcttgtctttgttttatttatttttacccatgttgcagtgtcgtgtaatgaaacttgtatgctaatgattctgtttctttgtttcaaccatgatgtcccaattcttgtactagcatgctgttgcagtgccaatgttacgtcagctttaagcaaactgcagttctgttgtactcaacttaaaagaaaaccaacaacaataatgctgtaaaaaaaagtgtcttgtggataaatggtataattttctgcaaacaaaataaatttgattaattttatggaacatgttccctgtttgtaagaattgttggtggggataattatgcatagtataatttttgttcaagagtgagatacgtgtgaaattccgttttatcccccagtttttagaagaaatcaaaattcattatggagtagtgtgtttcacacttttatcactaaaatcattcatgttttactgaaactagacaactttataatttacattgtacgttactgtatggtcttttgtagtatttcttaatcaagccatctaaattgtattgcatctacaactaaattcacgtaatcacagagctagaagagaggagttaagccttggtatttttttggttgtagtttgggtttgcaatcttacattggtttcttgtttgactgctttaggctacaaacctcttcccctgcacaagttcaataattgtgattatttaggcttttgattgctatgcttgcaggatattcttaactttttcacgtcagctcatttatatatgtgcatgctgagtgttttgtttctttgccagcccatctgggatgcagtggttaacttccatccccaaatttttatatggctgggtgataacatttatggagacttcaaacgccctttcaaaatatttggacaggaaaggactgttggaccgtggaagaatgttccacgatttgttccttcctctgagcaggaaatgaaggctaaatatgaaaaagctaagtcaaatcctggctatgctcgactccaacagaatgctgaggtgcttcgttctgagcttttctacttgtttttgctctctagtagatattctcattcaaatttctgagtactaaaatggcgactatgcttatcaattcttttggcctgactttcacatttggtatgttaataggttattggtacatgggatgatcacgattatggattaaatgatgcagggaaagaatttcatggaaaaataaccaaccaaaagttgcttcttgatttcttggatgaacctcaaggtagcccacggtgggtggataatctcttttgctgcattatcatgtcgagcgtatctgtattctacagcttgggtgatttgatttatattcttttaagaaatactagtatataattgaatcgttcgcttgattccgggggttgttttccaaaggaaagaaatcgcctttttaaattatcctatggctgtggaacctcattattttcttggagagtgaaggcatgtttacgtgtctggctaatatacgtattcacccattaataaattttaatggcaacagatacagatttagattttagatacttatactctagcttctcatttcaggcggaaacaggctggtgtatatgcctcatatacgtatggtcctgtaggtagagatatcaaggtattgatcaaataaaatgtatcttctttgttaaattgataaagtcctttcacgattattgtgctgtcataggatgtaaccatgatcatcttaaaatgtcttttgatgtttaagaactcattttgtttttgtcaataattgacttgagagttgcttttaaattgtgttttaacttttaagcatgcctcttgtgcttatatttgcttttactgtggtttggggaaaactgttcagattgtcctcttagataccagatatcacagagaccctgtaggaagtgatggaaccattttggggaattcacaatggttgtggttggagacagagctcaagggtccaccaacagctctcaccataattggatcttctattcaggtacagcaattaggtatcaattgttataatgccagagattaataagaattattcaaaatactaaacatgataaatattattacatgtcatctgcatctttatgagttttgtctacattatcaattattatgcctgtattcttgaaactgtatatctatatttgactgggcgcttttctcatgaagatcttgctgaactcaatatataattcagttttgtgcttgaattgttgcacctcagaaaattgagattcgtttttatattgttaatatgaaatcatttctatattcttttctatgtcaggttatatcaaatctttcagcaaccattcatccattgttctcaatggaatcatggggtcgttttccaaaggaaagagatcgcctttttaaattaatcgctgatagtaaggtaacaactttcagtacattcattttctatgttttacatctatgttgttaaagggaatcaccttggtatcatttacgtagctgtagtgaggactcatttcacttcttattagtcttttctatgcagagggctggagtattttttattagtggagatgttcactttggggaaatcacgagatatgattgtgctttggactatccactatatgatttaacctcaagtggggttactcaatcagttgaggaggttgtcccatctttcttgcgttcttttgtgagatttgtggcatggtggaccccatctacaatgagagttaaggaccaaaactgcagatacaaatcctgtatttatggtaaacttgtcttccttatttttgggtaagaatatttactgtatattggctttcatgttttgatgtttcaattgtgccattaggtcagccaaactttggaactattgaaatagattgggactctcacccagtgactttgaaattcaaagtcagggacaaggatagtgtcacagttacaggcgttgatgtttcattaacggaattacaaccatcaaattcagagattttagacagggtaaaagcagagcataataattcaaagcattgcactcttgaagttagtctaccatggattgtaagatatcgcctggcaatcttgatctttttcaccttatttggtaagtcaattctaagttccacttgctagtgatcctctgtgtgtgttcgcacatgcgtgttatttactttggatttcactcttttaaagtttccatgcatagtatgattaaaactgaattgtttgtgtttttggtattttgcttactatcatttggtttcaagggataattttcattttttttgttgcagtgatgtttgtttcattcctagtgctagtttacacttgcttcagactttgccgacttgaaagatgcaaaagaaagcacgattgacaatcgtagatatgtacaaagtcagcaaaagggagcatgtgttattatctattctcctttgtagatttaacatcagtggttataggtcaataaaatgtatagattattcttgtactgtttccactaatcaatcctttatcaataggtacacttagaagttggtttttttgtgagtgaattggtggttgagccatttagatatgatgcatagaatgccatgatggaatccggtagctttaggtgctgcttcatgtgattaatttgttagtatttcataagtttgtgttcagttgtttaaaacatggatttgcaaatttggtgtgcacttgtatcaagagatagaaaacaaaaagaaaattataaatgaattgaggtatcttcttggaaaagacatgtaattcgtggcgctgcttcacactcagtttattacaccttttcctacacactctatggtaagaaagagaaatatgtattggtaatgaaaagaaaaaagaagaaaaactaattgtttaacttgctatatagtttttgaaattttaacttctcaggaaaaaaaaattattccatggattaatctgtataataatagtaaaaattctatggccaaagttactatatttactttctgttttagccgtgataaccaaaaagtcctgataggaagtcaacctaaagtcaacaaattctatcatatattcatacgcaacttcctctctttttcctcaggcttcattatcagttgcaccaacaatgtgttttgacgtcaaaagaaagagggtcttttccatttgagatattcttgttgtggtcaatgaataattggcacaccattattaaaaatttaaaatataaaataattgcgattcaaaaattaaaatatataatgtaattttttcttggcgtttagcttctgtcctttcattgaagtcaatgtctcttctactgtccaaaacaacgatgcgttagaataatttgtaaaaagaagagaacactagaagaatagagtatacaccagtccaaaacatgcaactgttatgggttggtacacaactttttcttataataacaatctgtactttatattttcataacactttttttttttttcttattacattactaattttttgctacattttttatttgatcttttttattgtaaaaattatcatagtaagaacaacattatccattttctgcgtctgctacttgcatttttttccaagttaaaaactagtagcatgatgtagacggcaactcgtgtgggatatcccctcaagcaagggaatcgtacatttgtcctcttattttctctaaagtcaaactacaatttatcctcttcccatttcatgtcatacaattctacatcgtagcagtaacgggtggaaaaccaaaaacaagttcatacttattactttatccgcttaaacgtgtccaaggctttaagtatcaatcacaaagataaatttgttgatattgcagatacatgcgatggacacatttctaactaacagtcaacacttaaaaagtcttaatgtttgttggagaaaaaactctctgcacaaatataacaagaggataaattttaataaaaacttgtatatttcactcttatatttacacatatatgcaccttttatatagtattttttatatcaaagttagttacaacaaaaataacaaaaactaactattatctaataatctaactaattgctaattacatcctacgaagaatattctaatctgaatcagaatattccagcaccctaccaagatattttaattgttgtggagtaagtataaacttcatggtaatcatagttaaacccaaagtgttttttaaatggtcagattgatttataacaacattgtggtggcacgagttcttttagaacgtaaaaaacagagttcgagacttcgaggcaacaatttggagaagtccatggtgccctttagtaaaagttttctgtaaaaattgagagctacaagtttttgggtattctataaaatggatctagtcttttgaacacgttccgaatgcagttcgaggccaagatggaactgcgtctacagttggatggaaatataaatctgatacaacatgaagagagtggaaatttctaattttacctaaagatttaaaaactttgtcacatgacaacgacttaaatatatccaagatgaccgtagtgagcatgacggtcatgctaatatgatgacaattatctttgaacagtgtcaaccttccgatgatggccatggtgaattcaccatggccattgataaataagatgaagtttagttcattaaataaagatgaaaacatttatatttttagtaaaggaatctccaaaaacatttataacttgtatttaaataaaagtatatccgttgtcatcttcaaatttaattaaagtagaacttttacttgttacgaaatgctctaagacttggtacaaggaaggcataaatacaatttcacgttaggacaaaaattctatcaatactttatgggtacttaaaaaaatactcaggatattgggtacatctgcattattaatcaactttaggaattaaaatattctatttaagaataattatgttaaatgattatattaatcatgtcgtatgattagatttatatgatttaaagaatgatttttcaattcaatttggagaaattttttaattaataatttttatcaactaattgattttacatataagtaaagtatgtgtaacagtgtgagtatgtatgaatatataggtgtataaaagatacagatatggagaatttttttacattgatatagagatggagattaaagttattactatgcgatatgaattcaatatagatattttttttgtcaagtgtatttttttttaaaaacttttaacatgaaaaaatattgtactaattttatttagcgtttttgaaattaataacaaagtaagtttatgaaatatttgttgagatattaatcttaagttacattttattaactttaaaaaatagaaatcgttaactatactccataatatatatgtttaatagttcattaaaatacttaggccaaacatgagccaaaatattcccttttaagattaaggaatgtgtttgcccaaaaaaattgtaagagctgagtgtattaaaatgtcccccacatcacttaggaatatataaagtcttagcctgtgtttggatatatacgtaccccggaatggatgacgcacatgactattgaagtacatgtttaattatatgaagaaattatttaattattatttttaaaaatcttctattatatttgtttatattattcactaaaaagattataataataacagaattgttgttagagcaaaaaaaaagattttagactaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaattgattgaccaaccctctatatatatatatataatataagaatcttagaaaaataattagtctattcataagaagagatgagatcatatgaaaaatctaacttattctttcctttatttttggactattggccatatgcaattttacatttttagaggatcgatgtttagttttacattgaaaatttgattttaggtttagaattaattgtgttaaaataattttaagttaattttttgttgaacaattaagtatctatttggacacatgttccaacataaaaaatcgcgtccaaatgtttaaatacgtaaaagctacaatggactgcttcataagtgataaaaaaaaccacataaaataagtgaatgcaaatatattatttatagaaataaattacgataaaaaaacattccaacacaaattacattaattcaaaatcaattaacacatgcgcgtgcatgcgaagtgtcctttagttacttatgtgttattctataaatttgacatggcattcccagtttcccacccatgtatcattcaagttcagtcgatttataatacaggttttggctggtaataactatatataacaaaagttaagacttaagacaagaacattattctttttttaattcaacaggggtcatgtgtgacagtgtgtacgtacgtgttgctcgattcatacctctcaaaacagtgttgatgaaaatgaaaagacaggttcttatcatcattgtctgatataggagtgcgtctgaattgaagttttgttgtgtcacgaaattaactggccgtttcttgaacaatatattgaaagtgacaaatgtaagaaacattcaaaggggtcgaatatatacacctttagtaggtgtgttcgttcatgcaatgcaacaggttagatttttaatattcatccacacactgtgatgacaagtagcaggagctaattgttacacgcaccccatgagattcgctgatgcatcaagtacctttccagacaaatttattctctctgccaaagttggaggaagtttgagtttaaattttgagaaaataaaagtaaatattatatacatcaattgatttttgaatagttatttgaaatttatttactaacatgtcatcaaacacacattaaaaaaattgaaatattaaaaatcttagagatttcttttatataaaagataatagatgataagagagcaaagaatggtcattttttaatgaacaatacgtagtcaaataattattttctcttctagttagtttgaattcaattaaagtcaataataataataataataataataagaatgataaggtcaataatagtcattagaataaggaagtggataataaataaaaataataataattagagttttgttttaaaaataatgcaaatttaaggtgggagtatgttgcctcgaactagggtcaaggtaggctcccaaattttgttacatcacttgtctgatgcttacaagtaatagtcactaatatgtttgcatttgattcatttggatctatatcatgtattaatcacggatggataccaaaggtgggggctaacttactttggtacgcaaagtactctttcaaaatttatttttaaaaaaataaaaagttttcattttataaaataaagctaatagtttaagcgaattctccgccaaaagaaacagcagaggaaaatatttagggttgtgagtgtccattgaatgttagcaacacatctttagatatattcttagaacactttttttttacaattagtttaaatttattaaaatctgcaaaaattaaaagtctcattttttttatttatgaatacacttataattttatagtttttaataatttattttatataaataattgtattttaaaaattattattaacacctcttaatatattaaaagatagataatcagtcaagagaataataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacttctagtctgtgttctttctttatttcttttgattttttttgggtctatatatcttattttatttttgttagacttgaactttaatgaagaatttgattttaatttccacattgttctagaagcatgcattttctattgtcttcgaaaattgccaatagacaacagtacaatcactcacatagtcacatggacataatctcgtattatctacgcattgtattatcaacagtataaacactcactgactcacattgctctagaacctttcctttaacacatagtacagaagaggatgtggtggtgttgtaattgcatgttgataaggatcattttctcctttaacatacattgagcatgttacttttagaaaatgtttaacgcaacaaatgatgcatacaaatgcacttctccaaaagcttcaatttctggcttcctgtgtaacagatagaccaacaaagcttttcaaatttcaactaaaactactcagttaaaatttgctgatgcaacaaacaaacgtacctgtataatccaccttcatcgtccaattaattgtttgttcatcatggtaattacttgataaagcaagaggagcagaagaacatggatttgtaaaagcttttctttttccagatgttcactacgactgtgactttgtgatggcaaattaggagtgcctatactgttccatcactttcccaagatgttgttttcattaggccagtacggtcttcttaagccacacaacaatagcttataaaactccaaagcacgcggacacaaactttgcagttcagcatttcaggccactcatcttctcatcaagtggacctattacaaactagttcttatcaaacttgtctttgtcatgacatagctaattaactttgcatttgcacactaccttctatatgttgcaactcttggagctgaaacactcacgcacttcagcaaaactctcctcagttatccctccaacagaagataaaacatggtgttaacttcattttcaagaaccctttttgattgttcaaagcttatttctatactttgttgatgtcttaatgatttttgcatttttgctatcttctaggttctagctgcaagtcatggcgaggaggaaaaaggggtagaaggcattgctactgttgattttcgaggtcaccctgtagacaagacaaaaactggaggatggctagcagcagggctcatcttaggttcatattcatctcaatccatagaaattttagtcatgttttcaaggttgaaccaaagcgctcttcaatttggctccaacacatactttttcttttttttatgtaggtactgaactggcagaaagaatatgtgtgatgggcataagcatgaacttagtgacctacttggttggagttttgaatctcccttcagctgattctgccaccatagttaccaatgtcatgggaactctcaacctgcttggccttcttggtggcttcatagctgatgctaaacttgggagatacttaactgttgccatatctgcaatcatagctgctttggtatgttaaaagctttgcatatttagatatactcaatgctcaattctctaatttcttttggcttttaatcacactaaagcaaccaatttctcccttccctctagggaaagtggttttcaattgcaaataacataattttcttagtttaatttctatgcacctaactatcaatcaatcagaaacaaaaatcatcattagtatgacttatgacttgtaaggtaaatattataaaggtcaataaatttattgtaggttagtttgtaattggataacatgtaactaagtaaatacactatttactctaacatattactagctatactatcagtcacaaactagttttcttatcacatctttcttggaccagggggtgtgtttgttaactgtggctacaaccattcctagcatgaggcctcctgtatgcagcagtgtcagaaaacaacaccatgaatgcattcaggctagtggcaaacaaatggctttgctatttgtggcactttacacagtagcattgggtggtggaggaataaaatccaatgtctcaggttttggatcagatcagtttgatacaacagaccccaaggaggaaagaaggatggtgtttttcttcaacaggttctacttcttcatcagcatagggtccttgttctctgtggtggtgctggtgtacgtgcaagacaacatagggagaggatggggttatggaatttcagcagggacaatggtgattgctgttgctgttttgctttgtggcacaccattctatagattcaagaggccacaaggaagccccttaacagttatatggagagtgctgtttttggcttggaagaagaggagtcttcctaatccttcacaaccctcctttctcaatggttatcttgaagctaaggtcccacatactcagaggttcaggtaaattttctgtctaagcaatgaacatgactaagagtaaactacttacagtattagttcttgaaattaaaaaattctaaactttttttaatagtaattcgttaatcatattagtctaaatttaagatggacatattactgataaaaaaagctattaacatatgtttttgtattgggattgaccacagtccgtatggtcaaattgtaatgataaatatcatgtgaaatatgtttaaagattaaaatataatttcttaattttaagaactactaatatgacaattttatacttccatgtaccaaaatggcaatttactcttaatattatgtcggattgtctttttcttcaattattgcacagcaatttcaaaagattttctcattttttgtggttctgataattattactttcacgggattattactatttctattactatctgggacaacataagtgtttgattgtctctagaaaaggacaaattttacgtttgattgaacagtccgtcaaaaaggaattttgaaaacgaaaaaagagcagcgtctgttggaaaggaatagtattttgcccttttttttcaaaaattattttgtaaagtgatttatgaaaactattttttaaaaaacaaaaacaaaacaaaaaaaaagtttttttttagagtatatggttctgccaatgagcacatatttcctcttgacacatctctgtcacctgcgagaaatagaaatgagacatagatctgtctcactcactcacttaaatcacaatggagacgacacatctatttttttttcagctacacactattctgtactccactcagatcacatttagttttgaatgtaattaattctgaagttaagtaatttgattttatttaaatgtttttattaaaaataagttattaatagtaaaacaacgaaaactgttctaatatagaagctatctaaaattattttagttaaaaaatagtttttagaccataaattcatttttcaacttgagattaaatataaatatttattcaaaaacaactattagatattaatgttctttaatgatccaacatagcatttagctttgggtgtttaggccttccacttccacaggcgacgagaatgaagcatgggtaaagagaatcggagaatgcaattgaaattacaaaaagaaaactttagaaaataaaatataataataacatttaattgaacatttaaatattaaaactgacatagaatatatatatatatatatatatatatatatatatacacacacacacacataaattatgaagctgttaaaaaaaattccgtaagtatttttagttaatctttgtacatatcttctaatattttattttcgatataataaataatagtgataaggtttaaacataaaattttatatagattacctaaattttttacgagtaggccgatcctattagatcgattatctaatgtgtattctactctttaaaagagaaaaatcctttactccaccactataacatttttttttttttttnnnnnnnnnnnnnnnnnnnnnnnnnnnnnnnnnnnnnnnnnnnnnnnnnnttgtggtacactcctacgaaacttccagaaaagaaattacagtgatttgtaaattgtaactaccgatggcaaataaggcactcattttgcatggctaattatataatagatccaaatatcttgcattagattgaattatctaactgcaaccttaaaacaagttttggattatatgattttaatttaataccatatttattcttgaatcaacatatgtccatagctatgaattgattcttcggtgaaaatacaaggaacgatttataataaaaatgtcattcatttcctagggaaatagttcactgctttgtatttggtctgacaggttccttgacaaagctgcaatcctagatgagaactgctcaaaggatgaaaacaaggaaaacccgtggatagtttccacagtgactcaggttgaggaggttaaaatggtaatcaagctccttcctatttggtctacatgtatcctcttctggacaatctattctcaaatgaataccttcaccattgagcaagctacattcatgaatcgaaaagttggatctctagttgtcccagcaggatctctatcagcttttctaatcattaccattctcctctttacttctctaaatgagaaactcaccgtgcccttagctcggaaactcacccacaatgcccaagggctcacaagtctccagagggttggaattggactcgttttctccattgttgccatggcggttgctgcaattgttgagaaagaaaggagggtgaatgcagtaaaaaataataccataagcgccttttggctggtccctcaattttttctggtgggtgctggagaagcatttgcctatgttggacaactagaatttttcattagggaggcaccagagagaatgaaatctatgagcactggacttttcctatctacactttcaatgggttattttgtcagtagcttattggtggcaattgtggacaaagcaagtaataaaagatggctaaggagcaatctgaacaagggcaggttagattacttctattggttgctcgcagtgctaggagtactaaatttcatattttttcttgtattagcaatgaggcatcagtacaaagttcagaacagtataaagcctaatgacgatgcagacaaagagcttgtgagtgcaaataatgtgaaagttggagttgatggaaaagaagaagcataagatatagtcttaaaatatcattttgtgtggcccaatatatagtgtgcaagaacaaaacattgtgccccgaatttgttaatttttgggtattttgtcgacctcatttaacgaggacaattgtgatgtataattaagtatttacagagataaaaaaaaggcaaacgacagtgtgagttgtttccaaaagagaaaaggcaattatggaataaattataaatattcccaaactaaaaagatataaataaatgaacacttgctagccaggtttcatgagcagaggcctgaatttgactaatgttatcagtagaaaacactacagaatcataggatcaaactatgacatgatcttgaaagcaaaatttagtccatttgagaccaaagctttaaacaatggcattggatagttttagtatcaagaagataaaatctttaagaacgcagaagactttataaagcatcggtaaccgagggaggtctgtgacttatgaccaacggaggccgtagagctctgtgcgcttcttccttctgcttgcgtgccttgtacatttcctcagtctcaataacaactaacctcttgacctacattaaatacaaagtttaccaatgttagtatacagagggataagtcatatcaagcagaaaatggacttgtgtagagcttttgctaaaacctgttggagcattcccctaactgtaggtgtgttccatcgcatgacagttcgattgcatttgcgcaagcgaagtgcttccaaagtgcgcctatggagcctcctggtccccggaatacccctcaccagagttatatagatattggggctccaagcaattggcacacaggccttgtatgccttgaacgcattcatgccttcagcttgaagtcagaacagcattaagaaacaaatcaagttaatatgtttttcatactcaaactagataccaaaattaaattatcatacaaaaatagattaaaaaaaaaaaaaacaagtttaaataaaatcagtcttgataagaaaagaaacaaaatccatacacttcattcaactccaatactgcatgtttgatactacttgatgcaagcagacagaaaatcttaccttgaataactcacattcaagaaaacagttagagagtgacaaaagtatatgcaaataaagtagtgaaggaaaggtaagaaagcatttataaaacctccttgccattgaaacaagaaaagattaaaaaagatgataataaaagagtgagtaaattacacagacaatctcctaaaatttcttgagattacacataacataaccctcttcttttatttttatttttatttttaacgtttaaagcaaccaccttaaaggggtacacggtgtaatgttttcaaacaataaagggcgttaatataatgtagaagaggtatcatcgtactgttcttccaacaattaagagggtttagcgtaggggtaaaaaaaagaagggcgtcgggagaaaattgacgaaacctcagggggtgtaagtgcaatttactctaaaagatatgtacaatgacattagctcaggcattttatcaaacaggtggtaggcagatacgcaagttagataaatcacaagagccgttacaacccggccaacacaagttatcaactacgattcaacgtgatatagggagactcaattatggatacaaactagaacatgattgcaaattggaacaaacaaagggaatgaactactgaaaaaacaaacaaactaaataaatgtgaagttgtgaatagcttcaagttaagaatcaaaaagagagaaaggattaccgttacgcgcgcggtgcgtgagcgaagaagaacaatcacccgaaaaggttatcggctggaaggaaatgcggacaccactgacggaagtgtttgggttaaaaaatgagaaacccctaacgccccaatcaacaaaaagcacagtttagacttttgtgctaggagttttggtttggtgatccgggccgggtcgggtcggattatttgaaactatccaacagatttcgaaggggaaaaagagtcacacattggtgaggtaaaaagttctcttaattgtaaattgtgttatttaatttttattattctgtaaattttatcaaagcaaattttttttttacagattttatcattcaaaattttaatttggtaacattttattatagttgatggaagattgtttattttaaattttactatcgattataattttaactcatgtaaaaagtgattttctatattggatatgaccataatataattactttttgatatcgatcacaactacatatatacaaaattctagaaaaaaaataatttttatattgttttgttatcaatgtaatggaaaaatatataaaaataaaaaatttggataataaaatttacaaaatgttgaaagttgaatgatgaaattcgtaatggtaaaattcgataaattataaaagttggatgataaaatttataaaaataaaacttgactaataaaattcatgtaataataaaagtttgatggtaaattttgtaaatgtatttaaaaagttttacatagttatttaattataacttattatatattataaatttgttaatttttatgataattaatttaaaagttatattaaaggtaaattatgaaagtaccaaagtgtaaacaatgcacatcatgttgataaaaaagaaagttttttttttttgtttaaaaaatgttttgcaataatttatagtgtaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagaaattcaacgttaatcaattattcattattacatatgttatcatattaattcttacaaaaatcatctttaagattaatatagtgaaattttgtctttaataaatttattttatgatcatttaaaaaaaggaactaatgtagaactaacttgaagattatatataatattactaggaaatttatgaaaatgctggcttgatgtacaatttattgtagaatttagtattttataaatttggataggaagcttctcaattaagtattgaagttttttctcatttaaagaagcatttgtattacagttataatattatattttttaatctaaagaaaaattgattttttttcaaagttattaattttttttataattttaacaaattttttaattgaataattttaacaatttaattcccaaaattttattataatatttattttatatgttcacaataagtataagtaaatatcacccgtatcaggcatggggtaacacactggtacttatatacaacatttacacaacaatgttttcaatagatatacaaatttacaagttactacatgttgcataaggaaattataaaatgctattagtcttcatagaaaggcttaaccccattaggaccaattgtatgttacctcggtatagcatgtaaaacaaataactagtatcaagccctactatcaataacatataaagaaagatagtatattgaatgtttctataggtttttttgttttatgcacatactaaatatactttatgaaaagaaaaaatcttacattttcttaaggtctaattaaaccatcaaaatattacaaaatcatttgtatgtagatccaaagtcatgcatgaaaagtgctacaaataaacaaaggtcccacaccctatatatagtattaattaatccaaaaataataataacatacatgaacgacgtgagtgaccaaatgaaggcataagtatatttactattaaaagcttaaacaaaataaaatgagtttcctaaaagattgcaaaagtattatattttctaaagtaacataattatttctaaaataaatataaatataactcctatacattttgtgtttttttgacgaacagagaaactttctaaaagcaccatatatacttgatctaatttaatattgaagcaataatttgatgtgttattataaatttaaataatgaaactgtttgctccattgtccaactatgatgaagaattgtttctctcctattcggaggcgacctcctgaatttgggaaagatttgtaggattagaactaataatttgattttctgacgttgaaactaattaaaatgtattattatccaacataatctataatttataaacatatgaatgagatgatatgtaacacaaaatttttgttctattttatatcaaattaccatgattaattgtacaattctcatttacttttttctcactaccactaatgagacattgatatataatacataaatgatccataaaataacatttagttaattaactaattttgattactgcattaattaactaattttggagattttataaattcaaagttttaaatacttatgcttgtgtacttttattgatttatttaataatcgaatattatatgaatacccgctgattgtttttaaatgtacacatttgttcctttaaaataataaactatttttgcacaccccggacttaaaaaggggcttaaaaaaaggaaaaaaattcttatagtgatgtaaaatctacctttcgatctctgtccttctttccacatatcgatctatacacatatacatcattttatacaaaccaattttatatctaataatgataatctttctcagtcataatcatatattcgttgtttttgtttacacacaaataaaagaaacattagttgctgctccaaatgatggaaaaccttggttacaagaagcaaacaacaagggctcaatcatgaggaccgcataccaacactgtacgaccacaacatttctaacacaaattaacaaactcaattgcacacatatagtagacatgcaacacacgtgaatcaagaaatttttggacaacgataattataattatatacaagtagtcaagtacaactaatgagttcaacagcgttgtttaacccaagtgatgtgagataatatgagtatatataagactatgttgttaaaaaaaaaatggtccttcgattgatgaatcaataccatttagatttttttccagtacattaaattttttttatcagtttaatgcatttaggtatgaaaacaaatcattttcattaaattaggaaacaaaacatacacaacatctctagtgatctccacaaacagtgtagatgatagagcatatagttagattcacgctaacttacatagattgcagttcagagataacagagaattttcatcctgctttctacaatttaaagtaaaacattcatcaatgacatattaaatatagcaacctggcgacctaggaaactaaaaatagatagggttttctcggctaagcttttgaatattctagtagaggattgagttaaagaagcataggcatgccatccattggaaacggcttgcacataacattttccatgtagtagttagttgcatccatcacggcaaattgcatatcctcagaaggcttccaatggcgttttctctgattgatgaaccagttgttgatttgtttcagatctaggcctgtggattctgcaagtgcctgcttttgagattcctacgtgtttatccaatcacattcaccattgccataacattagtcatcggatatatatatatataaatagtaaacaaaactttatgaattaattaatgcacaattggctgttgataccaacatactaacaatttaacgtttcaatattgaaattcatattaccaggattattttctaattaataccaaaggctatagcaccatcaaatgtggctatattttggtgaaaatataaaggaaacaaggtattttgaaatgaaaatatgaatatttatcaatatacacattgtgaaggcatggtataaactataaagagaagtacagctaccacactctataatacgcacacgctactcttgattaaaatatgttaaaaatacaaaatcatacatgagactcgttaaacatgaagtgtgacccataaattatgatttttaatcattttcagccaaataatcaataaagagtttgttaaaaaaaagtgttactagcatttctctattgtttataaaggatgtagaacttagttaccgaagggtaaggccatttataatgcctgttccaccaatcaagtagctgttgccgagcttcctttggcaactttccattctttttcttcttcaaaaattccttcttgaggctccctagatatccactatacttgcgcaaaagctggactttaagttcgcggtcttcagcttgagaatctaggttgttttcatgaacatcaacctcattctgtgaagatgtttcactttgaccttaaaattgccacaacaaaatggaataaaaattaatagttcagtaaaaacaattcatgcaaataaatatccatcatgaaaatatttgacatcataaaattgcatgtcagttataactattgacaaccaacacagaaataatacataaataattctaaatcatactaatccccttactagataaagaaagtatttttatttttatttttattttataagacattaattatatttagttattcatttaatacaattttcataaagtattaagaggattagtagaataatatgataggaagatataacattattttattttgatatgtatcaattaaagaaagaattatgttaagattatatgttcatttttctgaattatcaaataacatgcattacctaagaaatgacaaaaacatgttaaaactaaatttcattgcaatgtttttttctggattacacactagctttgttactaaataggagaaagttgcaaagaaaataactgaactttagatcagtgcaaaatgtatctcaccatgcatacagataacttcttattataaaaggccatttaagagtacaacctttactaaaaaaaagtaagctattataaacaagagatatggttcactgttagagctaaaaatgtaaccctttcctccaccaccagagaacatactaaggaaggaagtaacaaaataatcatgcaaactcaaaatttacattggtttttttttttttttttaattaagctacagaggaaacaaattgacaaggaaacatatggcaacataagataagacaaggagtttcctttttcaactaagttcttaaagggactttgacagagagagccatgcatctaaatgaagagaatgaattaaacagaaagaaagaagactaatgccttgcaaaaggtgctcaatgagtacgtatgaaatagtgagtaacaccaaggtcacacgaaccaaaaagaaaaatacctttaaaaaataacccgaaggccatcaagattatcaatgggtcacttgattaagcagcatatattattggggtacgcataaactttttatcattagaataataaaacaaaatctcatttttcttgatttcccctcaagcagtaatatggattaatcatcgttttcaaactttttgacctaattcaaacaccttggacccattattattaacattcttaaaaacactgtaaaggtttttaatcaagttcctttataactaatcacactatttacgatgagaaaggtaatttgattaactctttccaattaattcagatgatgatatataataaacaaacaaattcagcatcacatcattcttagtaaaaacacatttatccagcacaggcaggtgtcgttttcgtttttttattggtttttattggtatcaattgcaccatcagctgtgtggttatcattaattactctaccacttaatattaatatttaataccaacatttagcattgaaagacaatattgcttctgaagatcagagttatgagtagtaactagctagcaaggtcatagatcccttcaatgcttgcagcatatttccagagggttaaaagactttgagacacagaagaactaccactagcctaagggtatagcaagttaagccgtgattcatcattacttagcctctaaccaaaacctttccacacagggttaatttctagtaataatttcatagtggtaaaacaaggatccatgattgtgttgctaattcattcatctttcttttctctcctatataatatataggtcacacgagcatggattactaattaagttgactctcacatatactgacacccaatctttgtcacccacttcccagaacaagaaatcgtagtccataattgctccacagtactcagagaagtgtaggaacaaataatgatttaagggtaattaatcaccaaaatctgatgaaactgctagggctttcagctgacactcaattcttgagaagaaaagcatggcttctttgaagggttttgttagctcttgctcatacttaatgagcatctcacagtaggcctccatgaactggtccagagctggatcttcacctattgaaccacctcctgtccttcctgatgatgcattgaaggactcgcatttggcacatgactcctctaagctagccaccacttctggaggtgctccaacctgtaaatactccactcacaccatcaaaacaagaaaaacatgaaaacacataaacaaaaatctcaaagcaaaaccacaacagaaaatttgagtcctcatgaaacccatgaaagagaagtagagatatgagtgcaattatagtttacaagttaattacaagagtgtatgatcttatagataaggaatattttttttttttttaccgaaaatattttttagttaatattgttagtttttgtctgcgagatttcaaacccacaacttctttttccttttcttcttcctttaccactaaaccaaccttatacattctatataaggacaatttgtgttaggaggaaagggaaatagatgagtgtaatttatgtgaatatggagaacaatatagagtttatcatcaccttgaggcaattgaggtaagaggacaagagacgaggaaaaagagggtgtgccatgattttatccctcacactgcaagtgtcggtggggttgtggtggctgtagtgatgttcctgagcgatattgctattgctagtgacaggtacccttctattatcactacttctgcgcatttgggcattaccagagttgttgttgttgttgttactgagaggcagagaaagaaacttcctattattagtttccatgttcatcatgtccatctcagaaagctcactgcaactgttccctccaaaccctatcatagtttcaaagtaataataagttgtgtagttaaaacccttgaaaggaacgaaaatgaaagtgctctctctctctctctttttgtttcactctctctcaccatgtaaaaataactaaaactcctcatgctacatatataatatatgtatttattttatattataaaatagtaatagtaaaataggaatagtaaaaccaatagctgtatgagtatgtagctctactacctctttggcttggatcagttgttcctagttactagtccccaccttactgttttctcaaaaagagcacactgcatataattgtccagagagtactcccggaaatgaagctaaaaaatctgagtcctttatttgtagaaaactccaaagaacctaaatggatagtcagtcagaacaatagggatttttgggctcttggctctatagcctgtaaaaggtggtgggaatcagattcagattcagattcagatatcagagtcctccccttgggaatgtgtagtctaccttcttccttctgtgcatcaacagtgttgctttgcttcttattaatctcattctctctctctctcaaaaacactactaccagtgtgctgttgctgttgctgtgtgtgttgaatgcaggtggagacacagaggctacacgcagggttaacgtgtggttctgcaacttaactctgagttttccttcccaatgaaataagatgtatctatgtatgtgaataatgtgaaactccccctcttagctagctaggtctatgcactaccactgtttatgcgtagtactattgttggctatctatcagtcacactcacatcatgaaattaatggaaatggaggagagagaaaaattgcttcactctttcactaaaattatatccaaagtaaaaacagtactagtattaattacgtacttatatgttatgcttcttaattatcttatatttattccatttttaacatgcttaagtgttaaaatattcctaagaatatttgcaagatttattttatatatagatgtgtaacaattaagaaataacttttgataacaaaaaggattaagttaactttttaacaagtactatgttagattgagatgtgcacattttttgttagttagattggaatcatatcaaaactcagtggcttagaataacggaaagtgttaaaacctgttgacaggaataaaatttaagtatttttaataaatttaacgtgttattaattaagttttattaaatatattgatattaatataatataatatgaaaaaaaaaatttagtttcactctaataaattgtaggggtaaagagaggagttggtgtgattgaaaggaatcaaacatcaaccgtccatcgacacctatcacccatgtgatattcctttgggagatattggatctttatcactctctcacacataccacttttgctttagtatgatggaattggtatatattagccactaggagggtgggttaatgagaggaagacgacaccgttttgtaaattggaatccatgcaaagacacacatatgtcagaggggtcatgtcaatctaatcaaatggaaaaaaatagaggagaaaaatgggttggaagagatagacatagcaaaagaagcccatgttatataagatgttgccctcattgtgggacactacctgcgtcccttcctttcagttcattactattgcgtttcttaccttaccctacacgaatgattgacaatttgacatattgtgttttgccattttctttctcaataaataatatatttacttataatacaatatttatttatataccaaaaagaaaattgtactcagagtctaaaatattctttacattatcaccacagattaccatatattttttacaatacttatatatttttagaacatttacagccattatcttttttttatactgtacagtaattatcttataaatatattatttctaatattatttataaaaaataagttataatataaaatgcatcataacttatttcttgtaaatagaaccaaaaatagtattaagtgttatttgtgattatatgactattaaataatttaaataatatcggtgctaatctaatggtgcaaaaatttaaataatttgtattaaattttctgttcacattttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattatatatattatatttaactattagataaagaagatgaaagatgaaatcaaagaatattaaaatactgttgactttagatcaaagagttaattctcatccctatttttttatttatctaataattttaactagtgacttacattcaatagttagaataaataaataaataaataaaggatagatataaaaaaaaaaagtaacgctttcagaattaatttttggaataatttaaatatttgatcactcgtttatacaagattacagtagataagcgcatcggttaagcatgacagtagatatttaatttctaaccatgtatacatacaagtaaattattagaaaaataactcatttctttaatctatttaaaaaaatcacttaaaatgtctaaatattaaaaaaaatagaagagaatatttacttttctttcacccacaccatgctcctgttttctatatttacccctttgttggacaacggacatggatgatttgcggagagtttacggagtatctctctctctttcatttctttttatttttaaaaaagttaaataaatttttagtgatataatttcttaaaattaaataatttattttgtgttaaaaatagtagagtaaaaaattatatttaattaatataaaaaatataagtttatttatttttttatttgactctttttctgcttataaaaaatagagaattttttgtatgttatttttatttttatccattcaaattcaaacaatatatttttcttttactttttcttttttcttttttctttcctatctatttcacttctaatttaaacaaaacattattttttaaaaccaacatgttgttgatagtgtaaaactggatactattttgtgaagtaaaattttgagtttaagttttgttgataaaaaaaattataattaagagaaaaaatcaaattaaaattgataaatattttacgtcattttcatgataattaaaaaaaaaaaaaaaacattaatttgtcggtggtgagttcatcaccctgctaagtcccatcctcatcggaatgatatggtggagtttacttactatccttagccaaccatgcaatgccatgtagtccacagaatcgcacagaatcaatggtgaatttatctacgaaatatcataatgtcaacttcgaagaagaattagggttctataattccaagacatggatcggatatccctatacgtttaataatataattgctttagaacttactgtaactaacttatgatttactatttacagacatgataaagtagcttgttccacttgtaccctatgattgacaaattttatcaattaagtttttaagaaaattaaaagatatccatacttttttcccgatagttgatgatatataagaatgtttatgtctacatgagatgtctctcaattgtaccactgtaacaatattcgagaatttagtgtcaaaataatgtatatatcttaataaataaataaaaggcggaaggaaattaaggagatctcgattccatttaaaggaagtgtcttttatctgaaggattttctttcttaatttattttattttattttggtgttagaacgtttttcttgtatttaagaatatgataattaataagttattgttggagttttactcgacttaatcttcttgtataagattttggatttaagacttataaattaaaaaaaaaaaagttatgtgtcaaggcttaaagtttaatgacttattaatttatatatgccaaggcttattcttcttgtataaaatgacttataaaattaaaaattatacaagaagattaagtcgagtatataaaatggcttaatcttcttgtataaaattttacgtatataaattataagtctttattttttatttttacgtatataaaattaaaattttaatgcaaacaaacaacgtaataacaaagagagtaaccctgaaggtttctccgtgatttatttggataatgacttctaaatctatatatgttactatgcttcatgaaataagattttcttcatggggcagttagaatgaaaaagattgtcattttctttacattcagtgatgttgcaaaaagaacatcagctcaaaaaaatgaaaagttaacaaaataatataatgactaatgactagctgattagattcgtagatgcttcacttttttctaatagacaaatcaatttttattttttatgacaaaacattcttgctatcaaattgttgtaggctcgaggtccaatctgtaaaaagggttatattttagatcaattatcaaccaataatatacatgataattttaaacatctggttttatttttatttttgtgataaacatctgtttctgggccttttggtgataaactcgtcttttactttctgcgcctcattcttcgcttcatgcaccccatagaaaacttgaatggacaaatatgtcctttcttccccatctccatctcttgccacccaaaatcttccatagccaccaccacctaacccatagcaccagtagattcaccaaccacgaaccacccaaacatcatcgtggccaacaccgtgctgagccatctcattctggcgcaaccaaatcccaacccattcatcactcacatgtgcatgtgcgaccactcacccatactcaattttgggaaaaagttatattttttggaattgtgctaacataattccattcaagcatttccggaataaatgttgttttccggagtgctaacataattttggaaaaacatttctggaatttcttagagaggtagtagttgacaaaaaaaaaaaaaaacgttgaccaacataatagaaaatatgtcaaactctttccactctttttctatgcctaggagttgtgatattccgtctgaacagtttggtgtgaaagccacacgaatgaatatgcaaccaatcattggatgagaagagaaaacacgaaatagctaaaaatattccagaaagtaaataaaaagttaatattacgtcattttgtaatattcacatggatagaattcgtacaaaaatcatcaacttcttttcatattcattcaattgttcgttatcttcgtctctttttgtctttattactttgatcatttacactctgtttggagggaaattgagaggaagaaagaagggtaaaaataaatgtcttccactattttattttgagtagaaataaaggagaggaatgacatttcgtgggtttcatatgatttgacttccatccaaaaatataatgaaataggactaaaatttgctccttcactaaacaggccattgctctacttgagttgtggaatatcaaagcctttgtattgtcgttttcattcctcctttgtattgtctacttgaaattgcttgtcaaacaattatgaggtattgatctaacaagtttttcctatagacatgccatccttggcaactacttgacactgtttatcaactatttacactttaaccagataatactggtgcacggcacaatgagtcggatatcaaaattaggatgcggaacttaattggagataataaaaccccatgaattttcacattgaagataataaaagttatgatcctcctaataacaaacatagaattacaatttaccccttccccccactcacaccccccaccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaacctcttgaagatacaagtgtctctcttgatactagatcaaagagagtaatggaggcactaaataacttttattgtaattcatatatttctttttttggccagcgaacaaaggagaggagattatgcaaatgagaggtagagtcattttagattcaacccacaaatggatttttttccagtatgatattaatataaaatattcattaattttgttgataattaatctttatctgaaaatctaattaactatttttagtgtaatttttctttcaattatatttttttaatccacaagattcaaattagaaactttctttcagaaaattaaattaaatttcactaaaatgacttgttggtctcacaaaaatggattgaaagtaatggaatgagttttttttatatatatttttattattagaattagaatgacaaaaatatctcaatcacattttattacttatttagagtatagatgtcattttatacacacatgtaaagagagaagagagatcaaattacatcgatataactttgataattattatattatttcataactttcaattgaataatgttttcttcaaacttaccattggattgaaagttattttcacatgtatcacatgcaaaattttatattaattcaaaattatttgttactttgttcatataaattaaaatcaacttaatataaacatttcaaaatatactaaaatatgaatcatttgatttctttcttatagttcaattttgacaaaatttagtaaatacaatcttgataatatataaatataattcaacgattgaataaataaaaatcacatcttatattaatttataaaaatggtataataattatcaaaattatacaaggataatttcatccttccatatatatatatatatatatatatatatattcctttcattttatttctacttaacaacttaaaactttcctttcaatttctttcattaactaaatataccaaagaaaaaagtgctataacctataagaaatgcaaccaccattattgtttaataagaaaaagtaataaaaataatagatctgttaattttgtaacaaaataaaaactctagtaattaaaaaaatattttgtatgtttctttttaactaattttattcatatgctttaaatacagattttgacttctaccaaaatagtacagattttgatggagcccatatataatcctttcacatgaaattaagaagtcaaaatacattgatgcagatagtaactcaaaaaatgtttacaacatattaacaattgatttcatttttcttgtaatttatttgggaatcattgaagaaagaaaaaacaattagaatgtaaaaatcgattaacttcttaaaatcacttaaccaaaacataagttgaactacacatcaccctgcgccatgcgctggggtacacctgtttctgggccttttacatactgtttagtgtttgcacataagtctctagagaccttttctattttgctttatacaaggttgggctccctcagtctttccgtttttcccatggtcttctttatttataaattacataatctactttcaggctttttccaccctttttcacgaattatgttaaaaatcaattgcagttttcaactaccttacggggtgattgtcgccgaacaaagttaggcactaattttcctagtaatttttctccattcacacaacatttctcttataaaagcaaatttgggataaggaatctactaacaatgaacatttttatcaaattcactaataaaatataagtagatcaatcaatgtttaagcataaaaatagtaatttcaagtcgactgaaaatagaatctggtaaacaacctacaacttttggatgacaactgagttggctataccagcttgttctatagtctggtccaaatcagcgagttgtttgggaggaaaacccattgactgcagttggtaactgcttacacccccgggtcttgatgcatcaatgaatgctcgaacatctctgattgtatggtggtgattgaagcgagaaaccatgcgtgtgccatcagccaacctcagttggattgatgtcactgactgcgactcatctacaactaaacccatagttggcaatggagcagtacttggtgaagcaccggttgtttgaataggttcatcattgctggagctggtgctacctaaagttcttccaacaccctggaaagcacgttggcgtggcttcactggttcctgcataaaaattttgccaaaaggaaaaagaaatggtaaaaaccttaacataggatgatagatagatgcaaaaaactaaaaaatagaaaagggaatacagggtagtcttcatcccgccttgtgaggttgacatggacagcagtcttcctatcttctggctcaagttctttgggacattcggacttctttatgctctatattgaggtaaacaaatgattagcatgctctatattgggcagctttcacacgttgcagtgctgaaagcagtagtaactttagtgtacttgaaagagcttatttaaagcttattttatgacatgagcacttgtataaatatttgaaaaagctcataaaaatagcttgacatgttcatgaactttttttaaaaaaacttgtaagcttatttcaataagttattcaacttataagaaacaagctagccctattttatctttcattcaataagcttataacatatacataagtgcttatttgataagcacttaaatcctatctggataaacttttcaacagacattcataggagaaggaaaaaaaaaatgaattaagcttctctaataagttaagattagctcatgcccaacagcacaagtcaaaatcgatttttggagaagttaaatgagagaagttcaataaataaacttatgcacgaggttttaaattgcggctgtggtttcatcaattttcatgaatattgtggaaagttgcaacaaatgcggtcacaattgcagccacatacacttcaagaaaccttgatgttgcagccaaaatcactatcaccaacctcttcttaaaaacttatgtataacaaaaattttaaattcttatttttccttttttatttccttctcctatgaatcggcttatagaaaaaatttatgtaaacatatccttatttaataaacacacttaattaaactatttccccaaatgcacatacaccctcagaagataaacataagatatggataaaagcctacgaacaagagcttttggaagcaaaagtaatggcaaactacctccagaaaaggtgcgttttgcggatcattcaacctccgtagaggaccatcattgacagagaacccattcctccagaaagtgacagtgtgggtaacttcctctacacgctgaggagcagcagcagatggcaatctctctccagatagcaacctcgccgtgccactaaaacttgtcgacctcgacgagcttcgaggattctccggaggtgcatcaacagcaacctgcctcgcttgatcaaagatatcatccacattgttgttgttgctgtttcctctggtaggatctcgaacaagcatcccactgcatgtagcatcaaatatataaacacattacaacgaaaaaagccacattggatcttattatctcacaatcgtagtcttagaatatgaatttgggcctaactcaacaggttgtctctcacttatattctattttggtcatatcactagtaagatgtgaaatctctagcatacctcatttaccaggctagccgccacaactaaggagggccaggggtggttgcaattaaggcgactttccaacaattaatatgatcaatttacatggatacctcttttcgccgccggtgtagtactcgtcgggttcgaaatcgggatcggaatcggaatcatcatcgcgggaggagcgtttgagatcgccgagggtgcgaattttgccttggcggctggtggagggtttcttgccgatagacctgcgggatcggagctcgtagggcgtgcgattcggcgacggagacctcgaagggttgaagtccggggagtgagaatcggagggaggggaaacggagttggggtttgggtttgcggcgacgacgacgtcgtcgttttgagggatgagagggttgttggcgttgtcgagaaaagtcgaaacggcggcgtctaggtcgaaattgtggctctccaaaaagaaaagggcttcttgtttggaagaggaagtgatttcgcagaaggagttcaccaaagctgcgttaccatcgggattctctttctctccttccatccttttttttttttttttctcttcactctgtttctttctcacgcacacttcacacttcagagtcttttacaatgtcctacgttgtatatctatatatatatataatacacacacacacacacgttagactcacttgccacgcaatcatgcgtacgacgccgttttctacacttttcagttttcgctttatttcttctactcccacaggtcacaacggataccttgcgtggactgttgggaacccaaatcatctctaataaaataatttaaataatacaattttaataaaaaattatcaatttaagattatttgtaaacaaattatcaatctgggacagtaagttacgtccagaattaagcatgattggtcacgcccagatttaggcatgacctcaatcttcattaacacagcttttttaaaaaaaaaatatacaaaataaaaatatattacccatatcttaagtgagattatttttaagaatgatttatgagggataacatgttgaatgactatcttgttaagttattcttcaatgactatgatattaatcctaagaattactcacatcccgaggataataaaataatccttcaaacaataatttctaagagttattttgatatttgattttcttattttttttttaagttttaatctatcatttccatctttatttttaaattgaatttcaataaatttttaaagaaaatagcaataattaaaagaaatattgtatcacatataactttttttatcataaatttaaaatataatttatatgtttaaaacatttatttttataaattttagttttataaaaataaaggttttttaggactagtcttcctactacgtgattaattaagggtcaaattttcattgagagatgtttctatatttaatgttggacaatattctgaatataattgttttaaaaaaatattcgtgaaaaatattttttattttattttaattttctcacaatttttgctctcatttattacaagtaattattgtgaaaatctacatgacttttggtgtgtttttcggtaatgtttgtgaattatgaccatataatttgactttttcaattataagggctgagacttatctaagatgtctcctggatttaaattaaaggaagacctcacctttttacattataatttttttacttcagaaaaaataaatctgcaaactaaaattaaaaaaataatttaagatattataaaatatgatgttttcatatattataattgaaggaaagactttgcatatctaaagaagactaatcatccaaccacatgtctgacaccggtaatttatccttattagttacatgttgtattttacaatcatatatggtatcccttaattggcttacaagatcaaacataagacaattgatcgatattacatatggaccataaggaagccactgaagtaaaagacaattagttcacattatgtgagacggtaaaagaatttcccatggctatgttttgctgaaatttgagccaaaggtgacttcatgtccttcttactacacgtgacaggagcaaaagaaaaaaaaaaatcctatcatatatacattgtttaaggattgtttggtatttcctcttttcagttttcacagctctagaataatgttgaatctcttgatctagcaaaatctgaaacagaaacaacatgcattatttaaatagtaatgcttacaaaatccatagaagtgcactgaacaggtaaaacacacaaacaccaaccaaaaagaaatgaacctttaccttcaacgtaagctcaagttagaggcagcagctgcatctataatgaaggatataggttggcgagtgttggtgattttagtgtcatcaatggattttagtagtaatgtgatttactataggccaatgcgattacgcgttaagctttggaaacgagttagggtagtgcggagtgcacgcttgttgagccaacgcataattgaccgcgattacggtgcggggttccatgttgaattgatctcttattcatgtgggggattgttggagttttgtttaaactccatgggttataaataagaggcggttaacaattcaaaataataactactcctaaccgctcttgggaaaggttagaaaaataactactcccaaccgttctgatgaccaacggttacgatggttcatcgtcaagagttgcaatgtttggaaaagccgaacagccaagagttgtattgtttggaaaaactcctatataaggagtcatttggcctcagatttcaaagaatacgaaaatcatactttctctctacattcctgatctgttctctattgccagaagcagattgttcttcaagaattatcccaacaaggatttcgtgaacccaggcaagaatagggtcgaaatactttgttcggaaagtgtacgaacacgattctttgaagttatccaggattatcatacccaaattttctaacaaacgaacaaagtattttctgataatcatggatggaggaagcgttggaggaagcacagtcaaggacatgactactaatttcggaaagttggacaagtttcaaggacaagacttcaggcgttggcagaagaagatgcatttcatgttgacaacattgaaggtggtgtacgtcttatctactccgattccagaacttcttgaggaagataccgttgaaaatataaggcgcagatcaaagtgggagaacgacgactacatatgcagaggacacattcttaacggtatgtctgatcccttatttgatatttatcaaaatgcagaatctgcaaaggaattgtgggattgtctcgaatccaagtacatggcagaggactcgtccagtaaaaagtttctggtgactgatttcaacaattacaagatggttgaatcaaggtctgtcatggaacaattcaatgaactcctccgaatccttggacaattcacacaacatggattgaagaagcgttggaggaagcacagtcaaggacataactactaatttcggaaagttggacaagtttcaaggacaagacttcaggcgttggcagaagaagatgcatttcatgttgacaacattgaaggtggtgtacgtcttatctactccgattccagaacttcttgaagaagataccgttgaaaatataaggcgcagatcaaagtgggagaacgacgactacatatgcagaggacacattcttaacggtatgtctgatcccttatttgatatttatcaaaatgtagaatctgcaaaggaattgtgggattgtctcgaatccaagtacatggcagaggactcgtccagtaaaaagtttctggtgactgatttcaacaattacaagatggttgaatcaaggtctgtcatggaacaattcaatgaactcctccgaatccttggacaattcacacaacatggattgaagatggatgaaacaatatctgtctcaagtatcatagacaagttgcttgggggaggtgccatttcatgggcttccaagaagcaaacatgtataactagttctacaatggaatctgagtttgtagcattagctgctgctggtaaggaagcggaatggctaagaaacttgatatatgagattccaatatggcctaaaccgatatcaccaatttctatccgttgtgatagtgctgccaccttggctaaagcctatagtcaaatatacaatggaaaatctagacacttgggtgttagacatagtatgattagggaattaatcatgaatggggtgatatccattgagtttgttcggtcgcaacaaaacttagctgatcacttgacgaaagggttagctagagacttagtaaagaagtcggtaatagggatgggattaaagtccatttaaatattctaattatgatatacccaattcccttctaatacaacgttagaagcagaattcaatgtggaaagattatagttagagattggagcaattatgtttgtcttcccaaggtttttgctcagacctgcaagtgatggttaggttgaagtatatcttcttaatggttcttttgaaaaattgtaaaagcaggtacaagattaaaaggatcacctatgtgagcatgaagttttgccgcttcaagaagtttggatttggcttcctatatgcttacgaatggataaggacacatggcttgtaaagtgtcaagtatgaatagtagagtgttgtagaaaacatgtgtgtacaatatcttcagatattcaaataagttgacggattcaatcgtaacgataccctgattcttgaatatatggaatgtgtatttgtactaagatgaaattcaatcgcaagacatttcatttatgcatttgtttgatcgttatactgagtagatcaaggattacactaaaatgggggggatttgttggtgattttagtgtcatcaatggattttagtagtaatgtgatttactataggccaatgcgattacgcgttaagctttggaaacgagttagggtagtgcggagtgcacgcttgttgggccaacgcataattgaccgcgattacggtgcggggttccatgttgaattgatctcttattcatgtgggggattgttggagttttgtttaaactacatgggttataaataagaggcggttaacaattcaaaataataactactcctaaccgctcttgggaaaggttagaaaataactactcccaaccgttctgatgaccaacggttacgatggttcatcgtcaagagttgcattgtttggaaaaattcctatataaggagtcatttggcctcagatttcgaagagaatacgaaaatcatactttctctctacattcctgatctgttctctattgccagaagcagattgttcttcaagaattatcccaacaaggatttcgtgaacccaggcaagaatagggtcgaaatactttgttcggaaagtgtacgaacacgattctttgaagttatccaggattatcatacccaaatttttctaacaaacgaacaaagtattttctgataatcatggatggaggaagcgttggaggaagcacagtcaaggacatgactactaatttcggaaagttggacaagtttcgaggacaagacttcaggcgttggcagaagaagatgcatttcatgttgacaacattgaaggtggtgtacgtcttatctactccgattccagaacttcttgaggaagataccgttgaaaatataaggcgcagatcaaagtgggagaacgacgactacatatgcagaggacacattcttaacggtatgtctgatcccttatttgatatttatcaaaatgcagaatctgcaaaggaattgtgggattgtctcgaatccaagtacatggcagaggactcgtccagtaaaaagtttctagtgactgatttcaacaattacaagatggttgaatcaaggtctgtcatggaacaattcaatgaactcctccgaatccttggacaattcacacaacatggattgaagatggatgaaacaatatctgtctcaagtatcatagacaagttgcctccttcatggaaggatttcaaacacaatttgaagcatggaaaagatgacttgtctctggtacaacttggaagtcacttgcgcatagaagaatctctaagggcgctggagggtgacaagggaaaaggaaaagaagttgctggaccctcgattaatatgatcgaagagggcggtaagaacaataacaatagaaacaaaggaaagaagcgtgctttcaagaacaccaaaggaaatttcggctccaaactgaaaccaaaactagaatgttggaagtgtggtaaaacaggtcacttcaagaaggattgccgttatgggaaaaaacacaataacgcgaatgcaagtggttcgggaaaagggtctaaggaccaatcccaaaacgaaggatgatgctatcgcgtggtggattgattctggcgccacaacacatgtttgcaaggatcgtttctggttcaagacttttgttccaatggaagatggttctgtcctctacatgggagatcatcattttgatcctattgaaggcaaaggaagcgtggtgttagaattcagttctggaaaaactattactttgtttaatgttgtatatgttcctaaattacgtaagaacttaatttctggtcctgtattaaataagcttggatacaagcaagtgtttgagtccgataaatttgtactatcaaagtctggtgtgtttgtaggatttggatattataataatggtatgtttatgatgaatttgaatggagttcctaatgattctggttccgtatgtatgtctatttcgaatgttatcaattcgtctttatggcatgctcgtctaggacatgtacattataaaagaatgcgtgaaatgtctaaagatgatttaattcctgtttttgatgagaatatagaaaagtgtaaaacttgcatattaaccaagatcactaggcaaccttttaaaaatataacaaggaaatctgttatacttgaattaatacatagtgacttatgtgatttgcatgctactccatcattagggcataaaaagtattttatcactttcgtagatgatgcatctagattctgctatgtttacttgttgcatactaaggacgaagctttagataaattcaaaatttataaaactgaagttgaactgcaacaagatgtgatgattaaaacattacgaacagatagaggtggtgaatattatgatcctgcattcttccaatccgtagggatcattcatgagactacggcaccttatacacctcaacaaaatggtgtggctgaaaggaagaatagagctcttaaagaaatggtgaatgccatgttatcttactctggtttgagtgaagggttttggggagaagccatgttaacggcttgctatttgttaaatagggttcctaataaaaggaataagactaccccatatgaactttggtataagaaaagacctaacttaacatttctacgtgtttggggttgcagggccgtggttagactcccagaccctaaaaggaaaactttgggtgaaaagggtgttgcttgcatctttgttggatatgctgagcattccaaggcttataggttttatgttatagaacctaatgactcgatttctattaacacaattatagaatcaagagatgcgatatttgatgagaattgcttctcttctacgcctagaccaaagaactctataccgatttaatctctaaaggatgatcacttaaatgatgtaccaagtgagacaatcgaacctcgtagaagcaaaagagctagaaaatctaaatcttatggttctgattttcaattatatttagttgaaggatcaaaggatcagattgatgcacaatactattattgttataatatagaggaggatccaagaacgtatgatgaagctatgaaatctcgagattctgttttttggaaagaagcaattgacgaagagattggttctatcatggaaaacaatacttggatattatctgatttaccaccaggttgtaaacctttgggttgcagatggattttcaaaaggaagatgaaagtcgatggtacaattgacaagtttaaagctagattggttattcaaggctttagacaaaagaagggattgactactttgatacctatgctccagttgctcgtatcactacaattagattgttgattgccttggcggcaattcacaatttagtgattcatcaaatggatgtcaaaacagcattcctgaatggtgatttggaagaagaagtgtatatgaagcaacctgaaggatttgtaatgcctggcaatgagcataaggtgtgtaagctagttaagtcattgtatgggctgaaacaagctccgaaacagtggcatcaaaagtttgatgagattgttttgtctagtggtttcattctaaaccaagctgacaaatgtgtatatagcaagtttgataaatccggtaaaggagttatcatttgtctatatgttgatgacatgttgatctttggcaccgaccaaaatcaagttaataatacgaagaattttttgtcatcaaagttctccatgaaggatatgggagaagcggacgttatccttggtattaagattaaacgggagaataaggggattgttattacacaatctcattacattgagaagatactcaagaagtttaatcatgaagattgttctccggtaaatactcccatggatccgggagaaaagcttatgctaaatacaggtaaatctgtggatcaactcgaatattcaagagcaataggctctttgatgtatgctatgattagcactagaccggatatcgcttatgcggttggaaagttgagcagatttactagtaaccccagtagacatcattggcatgcgataaccagggtgttcaagtacttgaagggaactataaattatggattgtcatatgtgggatttccttcggtgttagaaggttattcggatgctagttggataaataatgttgaagattcatcctctacaagtggatgggtgtatttgcttgggggaggtgccatctcatgggcttccaagaagcaaacatgtataactagttctacaatggaatctgagtttgtagcattagctgctgctggtaaagaagcggaatggctaagaaacttggtatatgagattccaatatggcctaaaccgatatcaccaatttctatccgttgtgatagtgctgccaccttggctaaagcatatagtcaaatacacaatggaaaatctagacacttgggtgttagacatagtatgtgtaacaccccaatatttcaatttattgtgtatggattaatagaaatattttaaggattattagaaattcaatctataagttgagtgacattttgtgctagatttcgtagattccgtgaatatcctaagcttccgtaaggccaaaaagattacataaagcaaaacagaggaggtgcaacaagcaaaacaggctgaagcccaaaaacaagaggcccaggtacagttagctcgcccaggcgaccaaatttgccttggttaggtcgcccaggcgagcaggtaatggcagacagcctgggatcgcactcagggtcgcccaggcgaccaaaaaacactctgaagggtcgcccaggcgaccaaggacggccagaactcccctataaatacccctaagcattccaaacattcctcacaccatttcctttctttctttgcttcctcccttgttctggagctctctttgagcctaggaatgcttggtttggctttggttttcatccaagagctattctaaaagcatggagatgatcctataagttatttttgagtggggttaggatagggagaggaataggtggtagtgcggaagctctgctcagataagaaggaactctctcaagtgaagaaggattaagggagccaacttgttcaagttctagaatcggctaaggtatggggtagttgtgttaaattaaatttagatatgaacctctgcttaaattcctatttatattaattaaggtggtaaaacggaatgttagataatctctaagcaatttataagtctttaatttgatatctaaaggattagaattatgttcatgatttattttatagatgatatatatatgtttctgaatgaagattttatacttcttacttgtttttctaacaatatgtcttgaggtttaaactttatacatggtcgttgaaatattttctaatggtttgaaatcttcaaattagtcattgtatttaattatattgggatcttgaaaattcttgtgatctattttaatggtgaactatttgatgatgttacgacgatacattgtgataaccatgtgatgacattgtgatgattttgtgaaaacattgtgatgattggaaaagtgaatcatgtgatgttgagatggaaataatgagaaaagaataattaaacgatgaatcattcatgcatttccatgtgcatctacccagtagggtagaacttgtgatgatgcgatgatcctcgtaaagaggtgttttgtcaggtaaccaaactgagttccatacgtgtttttaacttgggggtagttgagacagtggggaaccacaataccatgatgatcacatggatttgagtgagactcctatgcaacactgggctaccctgacgggatggataaagttcgttccactaaggtgagagtggggttatctgacggtggccacaattgtgatgttgagaagctgagatctcagtcatgcatcctatgataagataatcatgcatttcatgacaatgacgtttatactctgtataggtgtttacatatatttattattcggtacgttgatatttaaattttgtttatcatagctaaccctgtgttgtgtctggtggatgacacctgtgacgaccccaaattaattgggcgagcagatgaacagtaagcacgatcaagggatgatgacttgcgtgaagaaatgatgaagactgtgtgatgatttctgctgtgatttgctatgtcatgtatcttgatttgatgacatttggattgtaatattggaatatgtgaaacaattttcttatagtattcatatctattttgaaaaaaaattataatatttcctatcatttacaaactcatttgattattgtagaactttcagatgaattcttatttctaaactgagttttaaataacaaagactcttttagaacttttcgttttttcggaaaatttccgctgcaagtaaaataaatacgtaataaatacgtaatagttgaggtgttgcagtatgattagggaattaatcatgaatggggtgatatccattgagtttgttcggtcgcaacaaaacttagctgatcacttgacgaagggattagctagagacttagtaaagaagtcggtaatagggatgggattaaagtccatttaaatattctaattatgatatacccaattcccttctaatacaacgttagaagcagaattcaatgtggaaagattatagttagagattggagcaattatgtttgtcttcccaaggtttttgctcagacctgcaagtgatggttaggttgaagtatatcttcttaatggttcttttgaaaaattgtaaaagcaggtacaagattaaaaggatcacctatgtgagcatgaagttttgccgcttcaagaagtttggatttggcttcctatatgcttacgaatggataaggacacatggcttgtaaagtgtcaagtatgaatagtagagtgttgtagaaaacatgtgtgtacaatatcttcagatattcaaataagttgacgggttcaatcgtaacgataccctgattcttgaatatatggaatgtgtatttgtactaagatgaaattcaatcgcaagacatttcatttatgcatttgtttgatcgttatactgagtagatcaaggattacactaaaatgggggagatttgttggtgattttagtgtcatcaatggattttagtagtaatgtgatttactataggccaatgcgattacgcgttaagctttggaaacgagttagggtagtgcggagtgcacgcttgttgagccaacgcataattgaccgcgattacggtgcggggttccatgttgaattgatctcttattcatgtgggggattgttggagttttgtttaaactccatgggttataaataagtggcggttaacaattcaaaataataactactcctaaccgctcttgggaaaggttagaaaaataactactcccaaccgttctgatgaccaacggttacgatggttcatcgtcaagagttgcaatgtttggaaaagccgaacagccaagagttgtattgtttggaaaaactcctatataaggagtcatttggcctcagatttcaaagaatacgaaaatcatactttctctctacattcctgatctgttctctattgccagaagcagattgttcttcaagaattatcccaacaaggatttcgtgaacccaggcaagaatagggtcgaaatactttgttcgaaaagtgtacgaacacgattctttgaagttatccaggattatcatatccaaattttctaacagcgagcttggagacaagcacctatatcaaatggaagcaacctagaaccataaaaaataagattaactccaggaaggattgcttctttactatcattttcttttggttcagtttttatcgtattggttgtaacggcttcaagggattctttaattggttttgtggcagcttcatgagcaggaagtaatgtgtatgatctgcatgcaccatttaatagtagacttgggatgattaggaaatcaagattgtgagccatacagaaaaatatctttttgattattgtttgccaagatattggtaatagaactttatctaacaaaaaattaagaacctttaagcatagaattgatagaaatttaacaacaaaactaagaaaattgccatcacagctcaaaacttcattttggcaatgttgtcgattaactagttttaatctctggcgcacacttaatgcgccagaaatgcgagaaagatccactagtgaattccatcttccactggcagggtccataaattgtccaaaagcttgctctttctggtaaagaagctttgtaatgggacctgttgattgattggtaatttggtacccatcacaaatatcatgcaattttttccttaagttttgcatttcatcatagtgttcaccaaatgagccagattgaagcaactctgatgaaactatccttctacatatactaatgcacaacgttggactaaataatggcattccaaattcctcactcaatggcacccattcatatttctcttctgaataaaattggtctgattttgttccgttaaataatttcaatagtctaatataaccaacagtccacaatttcattttgttggccaaattggtcaataaagaattcaacttagaatcttcctcttcatttagtcctaactcttttcctacagagggaattgatccatcggcattcttcaagggcaaagggatatccaaagtaatcaattttccatattcattaagatcacatctactaagaggcagcaccaacacagctgaatgtttaagaagtgaatttaagcactgcaagaggatacttcccttcactaaatttcctttaagcttcctttgtaaccctcctattgtggaaccatcccaagaccatataagggatttctcacaacaagccaatggcgcaggaagcaagcacaggcactgtcctttcatcagaacaactgatagagggccactacctgcagttgagtataaaaccgatttcatccaaggactcggaagaatatgtgggaggaccaaaatgaactactgatgtctaggaagaattgttgaatgaggaagaggcactatggacacaagtataccatagtcgcgaagaaacaaatgatcaagagttgctggtgcaagagaagccaaactttcatagcgaagatacacgatatttcattttcctttttagcattcctgtcttaacatctgaactttcaaatactgctagtttctcattacaatcaaattttgtgtgtgccttgtcagcttcgtgaatgtgatcactactatcctccaaagtaatggaacgagtttcatcatctattccactaggaacacggtcggtgtaaatagaagcctccacaagcttctatgaatcagaatttattagatcctcattatttatcagtttctaaaacactacagtctcctgatatatcaaccaaagaactttcagctatctcagaacttggcccatcattacttgaggtaatcatactcagcttatcagaacttccctcttcttttatgctggtaactattcaacctgattgtagacactctaagacacaacgtagactaaataaatggttagcaaattcctgtaattctccctcatatgttgcaccctccaaggtactaagatccttgcaaagatcagcaatgctgccataacccaatttccctgcttcatagtgtgtaacagcatgagatttcaggcctgcaaagtttggcaagaagtataatttagtcaaacgcaaaaaccaattttgagacacacaacaagtcgtaatacaacaacaaagccttatcccactaggtgagatcgactacatggatcacacgacgtcattcagcacggttaaaaatcaaagtttcagaaatattattaagtaacaagtcgtaatgagtagtcaaaattttattttcttcttagtatttgtagagaaatttatccaagttgcctttaagaataataataactattaaaaaaaaataaaactacaggaaataatttaagcttgaagaggctaagagtgaagggtataaacctggtgaaacagatcccatcataagataggatgtaatattagcatcaactatgaaagcaacacaagtgtaggaagaacgaggtccattgtttcctgaagctgaagcatccccttgttgaatggagtcattagcataaagagtattctcataattttgactagcaacaaacgcatcttcatcactagttgtacttgcaacaggagatgcaagtatagtaactatagttgaatctccaataatagattctggatcaagtacttttgttgcccatcccaatcgacacacaaaagcagcagcagcttgcaactgtgacaaatcagcctgtagggttgttgccaagtccctaactgttacattttcatttgaaactacaaaaactgcatacaacaacctgaaagaaatagctctagcattagggtcaaactatatagaagtaagctatttgaacaaaaatgtggaaacacaaactgaaacaactactttactcttcaataggatcttcataagactgctccctgttggaaacaaaacaaagttttattttttaatattataatttcaaattttatgaattaatttgataaaactttttagataaactcattgggtagagagtaaggaattaattcttcgatataattcatttaatttgataaaacttatgtacgtaaataaaacattaacttatcattaatttcaattgtatagaaataaatatttatttaagacaatacacatattaaaatattacttaaattataattctgtaaaaaacatattttattattgattaaatttaataaaattaaaaaaagaattaaataaaaagtgagattcataaaaaattataaattttaatttaattaataataaaaatatttgtttttaggacaataaaaatatatatttagaagagcatataagagaacgtgtgactgacttttctcttataaaaaataaaaaataaaaaataataaaattcaaatatcaaaattgggccacctacatcatcagctttctctcactagggctaatttcctgtgaccaattctctctttttaacttcactctatttttcttgcattttcttccactctcgtagcatcttcttactcttattctcaatgtaagttctttccacttcttcattccgtcaatttcttcacgccctagctcatgcacccacaatccgtgaatttatgagtacaaatttcactgatgtttttcgtggtatgggttttggattagggtatttgggtatgcttaaatcgcaccctcccacgtgtttcgttacttgttttcgataatgttattgatcgaggttgtgaaagtttgattcttttgtagatagttggggttgggttttttctagatatgattaaacagatattcggtaaaatacctcgcaaaccctcaaaatcatctcacaataattcaaacggggaaggagggttcaatgatggtttctcactgaactcatcttctaataccctcttgaaatccaattcagtttcttcaaaatcttcaagttctggttcagttgggtctcgttctgggaatgagactattgctcaacactattcaaaccaatctaagaaattagctcctagtacaggttcagtaatggcttctgcagcttatgaggctttgcctagtttcagggatgttcctagctcggagaagcagaatctttttattagaaagttgaatttgtgctgtgttgtgtttgatttcaacgatcctgccaagcatctcaaagagaaggacgtgaagcggcaaactctacttgagcttgttgattatgtttcgtctgtgaattcgaagttcaacgagtttgcgatgcaggagatgaccaagatggtggcaaccaatttatttcgcgctctgccttcttccaatcatgatggaaggttggcagacatgggtgagcctgacgaagaggaaactgttttggaaccagcgtggcctcatctgcagattgtctatgaatttctctttagatttgtggcttcaactgagacggatgctaagcttgctaaaagatacattgatcattcgtttgtgttgaggctgcttgacctttttgactcggaagaccaaagagagagggattacctgaagactatcctccaccgcatttatgggaagttcatggtgcatcggccattcattagaaaagctatcaacaatatcttttacaggttcatatttgagacagagaaacacagtgggattgcagagttgcttgaaatattgggcagcataattaatggttttgctttgcctttgaaggaagagcataagctgtttctggcccgtgcattgatcccgcttcacaagcctaagtgtgttgcactttatcatcaacagctttcttattgcattactcagtttgttgagaaggacgtcaaactagctgatactgtgataagagggcttttgaaatattggccgataactaatagtgcaaaggaggtaatgttccttagtgagttggaggaagttttagaggcaactcaagcagcagaatttcagcgatgtgtgatcccactatttcgtcaaattggtagatgccttaatagcttacactttcaggtgcttacaaaattcccccatatttattttttcatttgtgatatattctgtctgcattcattttattagcatttactaacacctgtgaccacagctctctatctctatttctatgttattcatttccattcccactttgcttgtcttagctatcttagatgctatcattctatttatctaatatttgatgattacttgtcgaaactgcaatgaatttaacaaatgtaagcagctcaaccatcagatcagagcacttgtattgatactagaaagccaaactatgttacattagtattacctttttttcattgccatttctttttcttttgagtaaatttcataatctacctgaggttttgtataattacacaaatctcccctgtttttttaacatttacagtaatttccctttaggagagcctgatgtgatatttttcaaacaattaggggggttccagtgtatacttttaaataacttaagggggttaatgcaatgtataaggggatgcaatgtatatttttaaataactaagggagattagtgtaggagtagaaaaaggcaggggtgtttgtgtaatttcatgaaacttcagtggtagttagtgtttttactctttttttttttttggagttgggttcagatgtggcactgctgaacttttttcataaagatgttgtgactcgacattccttcttcctttcattattatttggatatcttatttatgccttatgaaataatagtttaaatctcacaaattttatgtcaattcataatttcattgattattcaatttttcttgaaagttggacttatgttgccaacgatatattatatatggttttcttttatgttaaatctcagaaatttgatatttattcataatttcatatgaaatgattattggattttgcttgaaagttgaacaacaaaatattttatatggttgtcttttatgttagaacttgtatttgtgacaactaaagattttgtagatttgtgttctgtgttacaagctgcagttctacaatacaacatactttagttttattatctggaatcagtctcaaagaattagatttgatgttgacttgattttgttggcaggtagctgaacgagcactgtttctgtggaacaatgatcatattcgaaatttgatcttacaaaacagcaaagtgatactgcctataatctttcctgctatggagaaaaatatacgggaccattggaatcaagctgttcagagcttgaccatgaatgttagaaaaatattctctgatgctgaccaggcactttttgatgaatgcttgaagagattccaagaagaagaaatcaagaatagggagaagcaaaaaaagcgagaatccatatggaaacaactggaagatgttgctgcagctaattctgtaagcaatgaggccatccttgtctcaaggtttgtgtcctctgttgcaattgctaccagtgcgaatcaattggcaactgcaggtggttgagagccatcagagatccaaattgtttgttctgaccacatgatgaggaacaaaggtgaatggggttgatgtggatatcaggctgctccttgtttctgggctttttcgtctccatcatctgttctggaatcttgggttgtactatgtatcataaggaatgtagtttataataggcagtgtttatttagaagtctagccattgagattatgcagtgatacaaaaacaatccttttcttttgccatatttatgtaattttaacattagtaaaatttctatttcttttagccttttgcagaaaaagatctgaacccattgttccctctggcagttatttgttcttcgctggctgaactgcttgtcacagtggatccaattttttttttttctttctagaggggggtcattacacgttcggagtttgcgcttttcattggaccttttcttatttactacttaacctttgtgggttgggttctttgggatctatgtctcctttccaaatgaatacgtttgctcttatgtttataacgagatatttcttgtttgctcttacgtttataacgagacgtttcttgtactcgtctgcatttttttaaatatttttatagaaggctgtaaaaaacaaattgaatctgtgtgcttaacactatgatgcacttactgcagagttaaatgttccactttggattatggacatttgtgatttcacatcctgcttggaagacaaaaatatgaagttggtcgatatgaacttatcgggaagtcttgccttgcagaggcagaacatgaaaaggatacaacagaagcatttaggactatttcttttaaatgatggcaaagtatcacaaacattcaaaaatattggtaatacatttagaactggaaaactagaactttaaaaaacatctattgcataaaacatccaaataacatgtgcatgttacttttaagtggttaccaagcatcatcttctcatcaatgatcatcaccatatgctctgaaactataacgttcttgatatggatcattgaaccagaggtcagcttcaaaccactttgggtactggaccaagtctccggccacaaattgcatgaaacgctcgcttccttcaggcacaactctcacttccccttcttctatgtacaccagttggtctacctgccagtcccaaggcaacctgcttttcccagtcttcaacactgaccattttgaaactccaagctcggctagtctctcaggaggaacttttctttccaccttcacattgtacaattcctccaaggatttctctatcctcattgcttttatgcagcaccttcctttagaagcattaactgactttctgaaacccctggaaccattgttgacaggagaataggtaatggctaatgttgtcaacaagcttgccatgcctgttaacagtttacaataaatgagcttcacttgcaaactagcacaaatctgcaagaaaggtttcaagaaattcaaagacttccaattttaatgatgagcattgaataaaagttccaacaggaaccaaccaacacatttctctcttaaattaccatgagtaacctcagttaatttttaactgcaaagggggaaaaactgacactataacatagccttccgttgattctatagtagcacgtgtagttatgcttccctatgtgggtttgtttgttttatttgtgtgttgtgctgtgtctgtttccatcagatatggctagaaaaggtaacaagtttccaactttttttttcttgaaattttgaagggtgaggcttaccttacctagtacctacacactttgaaacccacaacaatggaatggaaatggaccagaaaaatgaataacaattgaagttcagaaaatcatcaatgttcacttccggttgtttttagtcctaattgtcattcactcagaagagatatcatacactaaatacacataaaaaaaaccttcagtttccaaagcacaccaatcaattacaaatgtaaaaacactagttttctaattagggtttggtcaagacccaattcgtgaatgtgaggaaagtgattaacatacttgatgagctccgatgttttgacttctgaattgaaatgaacaccgactaaagagcagaaaaaaaaaaaagatcgaagtttttatcggttgaaaagatgcgcagggttgaagatgcagttggaggtttcgcttcgtttcaaccgttaaccgataaaccctgtgagaacaggtgaggtttatcctcaaagttgaaacctttattaagtagtaacagtggagtgccactctgttgcccacacaactatatgtatttaatacgacctacaaatatttcgtgaaaatatgttaacaaaaagtattaaaactcatattattaatatatttttttcaaatgtgatcatgcaaaacatatgaaataggaagcaagcaaataagaaaataaaataaaatagaaataccaaatttttattattatttgttcaaaagaggaaatataaatgtattttttttgttgtgaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaccttctcccacattgaaatggaaggagcaaaatgaaaaattctctctttttgattttaatttcttaataagtaaataaattttcataaaacaaacaaaatattgaaaattaataagttttatattaaaaaataaaataaaaatattattgtttttaaaattaattaaaattctaattaatctacaaaagtttatatagattatttatttcttttcactatatcccattaataatttaatattacttctcatatcatatctaacaaagatatctaggggagtaacttggacatatctaatataattaagcgaaaaatagaaaatagaaatatagggaaggaaaggacacagacagttttggtggttgaacgtgtcaacttgtggtgcgcaatttagttgccttttcaattatgataatgataattgatcaatcaaacagagaatagagaaaaaaacagttgcttgctttacttcgattactctcttgtttatctaaattttttgagcttcatttgttatgttaattcttcggcttcaacccattaatggaatatctcagctctcggtggggacttcattcccacacaagaaatgtaaccgaagacccctccttttgagatcacaagctgttccctccagaacccaggtaccaattcttcactgtgtcatgccacgttgtgttttctatgcaacaagtccaaataaagatgatgacattttatttttaatttaattgtaatgcatgatagtgttaaggtttctacactaacattcaatcatggattaccatctatgataaaattattgacttttgtaataattagtcatatttaaggtgttttctagtttgttgacacaaaaaaaaaattacactaaaagtgtaccaaaatgaaactcatttcttttacttttatagaggataatggagagtgtttcagtgagtggagaagttggtggtgctggtggagcttactcatatgaagccttgaaaagattagaccagctatggtcaagcatatgctcctctcaagaaggttcatgtcattcaatgattcttataccctttaggaaatgagactattttatatttttgtaatcttcttatgtatacattgcagttgtgcaagagcctcagcaagttgtctctaccatcccaggcttgtttggctcatctgatcttgctgacaaagcagagggatcatacgatgtgttagtgtgtggaggtactctggggatcttcattgccacggccttgtgtgctaggggtcttcgagttgccattgtggaaagaaatgtgctaaaaggggtaatttcagtttcattgactgagaaatcagcattcaatcctactcagaaaagagtcgataaattctttgaagggtcggatcaattttgagttgtctgtgttattttgatcattagagagagcaagaatggaatatatcaactaaggagctttcggaacttgtagaagttggagtcctggaagaagatgacattgaaagagccacagcagtaaaattcaatcctgtaattcctgaacttcttcagtttagtttccaatctctatgtagcaagaatcatctcggttaggtatttctccataactaatgtcttcaagtcactttgaacatacatcacatcattcacatgcctaaacacagtaagagatggataatgaggtcttgtttgttacaaagaaatgacaaaattcatagagcactgcaagatgaagttatctaacaaccaagggatattatcaaacagtataaaaaattagcatgttatctacttagaaacagagtaaatttagttgtcaatcccaatagaaaagacccataagtgtttaattttgtataaaaacttataaaggagaaactcattcaagcttacaaggtagagaaaaatgaaatacgtaccctggcagtcttactctgacttttgttacagttagataaatgttttattattaatatcctccatgaatattaattgacgatactttcttgtgttatacatgtgtgtctttgaagtaattacagaatgcgatttttatattacaattacatacttaagattgaatcaatgaataattttcatcctatttcaattcattcattttttttttcttgtgcttaaaaattaagaatttctgaattttcatgtaagttttgagttctcacaacatgaccattgcttacatattaagaagtattaagttcagtgcttcaatgtaatttccaaactgcttgattgttttttgttcctcaaagaacattcaatcaccaatagtttgtttctcctataggcaaaaaagctgtatcacaaatggcataactatgtctcaaatgtttccttcaagccatgtcttctcttgtaacctctctaggatttatggctcctactcttccctttaatttatttttcactaacttcactttggcaatttcatgaactatgcagaacagatgtggattcgaaaggaaaggggatatctgggtcaacgacatacttaatctcggtgtttcgtgagtctcattcccataaactaattcgatatacctgtaaataaatataataattgttttcttctatttcaattatcaatgaataatttaatctttgttcttatctagttaatatttttcttttattttttgtctggcttggcaatgaacaatatgcggtcgcagttgcttaaatttagtgcatgtttgaattatttaattttttggagaaaaatcacttctttattcaaaatctttctaattaagactttgattataatataaatctattttaaatacaaaatgagctaatatgatctagagctatcaaaatgggcccaacccataggtcaactcgttttggccgcataaattggtgggttggattacaaaaaagttggctcaccaagaccccgggtcatttggacccggctcacttaacccgcaacccacccgggttggctcgttggttgcacaaaaaaaaagataatggaaaaaatgaagatgataaagatgaaattgatttgtcaaaccatgattctaatattcttcctagacaatttaatattgatgattgagatatcaaaatttgacatttgaggagttagattggtgttttactattttaatattgttgaacatatttatatttgtttgagtttcatttacatttagtttgaggttaagtttgatgcagtttgtaatatttaaatttatttaaattgatttaatttgcatttttctacacttattttgtgattttttaatatttttttgatttttttaaaaaatttaaagtgaaccaacccgcgagccagcttacgggccaacccggataacccaccaactcggggtgggttgagccgggttggcaaaaaactaacccaccactaaagtgagccaacccagcccgactcattttttagccaacccatggtgggccaacccggatgggccgggttggcccattttgacagctccacttaattgttgtattttgtgtaattccttcaagagaggacaggaaatctgctgtagcaaactggatatagaattactaagaaatggcaagcagatgaaaaaaaaaacttgaattattatatgatgaatgcgcttccattagtactattgcacacaattttgaatattatctagacttggtgactctcagaaacatgcattttatttttactataggcgcagagtttacaattatgtactttgagtataaaattcattattctgttgaaaatcataatcatttttgctatttgcaattgcagacctgcaaagcttatagagattgtaaagacacggtttatctcccttggtggagtcatttttgaggggtgtggcgtctcttgcattaatgtatatgaggatgttgctgtgagtttaccttaacttttagaactagttattctagtgcatggctttttcattaagcgggggcttcaaacttagaagtcgtgtaacgtgacacgattcttttttttttttttttaatttaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatttatttctgcgacatgctaatttcggtcgttattttagttgttatttcagtcgctaaatttttttgcgacaaaatattatggtcgaaaaaaaaaaaaatgaaacatagcttagaagtcataaatgtgattacgactttaaagtcgtacccactttcacgacttctgaatacaatttttttaaaaaaaattaaaaaaaagtcgtgccacctggtgtgatttacccctaaacggtaattttttaaaacctacccccacttggtaattaaaaataaaaaaggcccccacttggtgaaaaaaccatcacaagtgttagtttattaaagggcatgcagcagatacagaatttttatatgttgaatttctgcatatatattcgcatttataaacaccacctaactagaggtaagcatcaaagggttatataaagaaagttactgtaccagaaaaaaagttacacagtagattgaggtgcgacagtgaagcatgcaaacatatcatacatgaacctagcattgaaatggaaatttcaaagtaccatttaactatgggactgaagaatgataagtttattttatttgatgataaagaagcatgaatgcatgtatttttttccaggttctgaaactttctggggacaaaatattgtcatcacgtcttataattgatgccatgggaaacttctcccctgttgtaaaacaggtcaggaatatattttcattcattgttgtattcttacagatagttcatgattttcatcacgtgatcactaggatgttttctcctttcatcatgttatcacgttatacaggctctggctgtcatttatatgttctcctttgtttatctttgtaagggtgattgtcttcgagtgagacaacataaaggtcttctgttgtgtgttctatcctgcatatgtaggacacattgactaatatatgtacgtgcaacatcatttaatatgcatgcaaatgcaagtgatgcaatatctgttaaataagtaattagccaactaaattcctaaatgattatgagactgggaggataggaaaataatgatctctttcatccagtattattgattgaatcatcaccaaccagaatgagactgattactccattgagaatataaagaaagtttctattcattaaagttctacatatgctaacttgatttaatgaaagatagataagtacctactgaatataaaaattaaaaccttttcctgaagcttcttccaagtgtcatgttcaatgattttacagataagaggtgggaggaagcctgatggtgtttgccttgttgttggaacatgtgcacgtggctttgaaacaaactccagtagtgatgtcatattcagcagttcatcaataaagaaagttggagattcaaaagcacaattattttgggaggtaacttgtactatatcaatagaaacacagatccccatctctatttttaagaactttaactgaaatcttcacaggcatttccagcaggctcaggtcctttggaccgtactacttatgtgttcacttatgtggaacctcaacctggatccccaaaattggaagaattgttagaagcgtactgggatttgatgcctgaatatcaggctagttttcttttcttcattgtgttctctgatggctctatttcttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccccttgtctgtgcttcctttcttttctctaataaaaattatttctctatgaaaaaactaagatttgaagtaaaaagatctttttattcaatttcctgttcttaacagccaaactagaagcttgaaaatggcagtctgtgtatgaattatcaagtcacaaaactgtttgtgattacattggtgttatgttactaatcaattccatttatgtacatcatattatccttgtcttttatctctgtttatttaaagagtgtctatgcaatcagttctgtaatgattatgctaactgataaagttttacactctttaaatattattttttgaagtcatataagtaaccaaaacatctatatttgacgtgatgcattcttctatactggtgttctactgctctcagcttgactgatgtcaatttgcaacttcgtttagggtgtttcacttgacaatttggagatactgagagttatttatggaatctttcccacatatcgtgagaggtattaatttggaatctctcccacaatttgttttctctggctgaaagttcttgcttcacttaagattgacacctgaaagcaatacagccagtcagccagtagtttgaccttgaagatttgaatactataagttaaaacacatcattcatttaattcctttgtcattcaaggttcctgtaagaatttgaaccatgtgttgtgcatggcaattcactgtggaagctactaaataagttgaacttccttatgcttgtttcataatgtctcaattcgaaattttcaaatgtttctttggctaacctgtcactgccagatggcactactccattaagtggaaataaatgaaccatccaacttttaattgcacatcagaaaattatctttcaacttgatgtgtcctctgtatctacctaacatctgctatttcccaagttcgttttaaatttatttcgtttcctcttacttatatctttacctatcgtttgtttaataactgtacaatgtttgatgaaatggagcacctagcagtccgctaccagctgcttttagtagagttttacaggtaaattacgttttacacttatcaagcctctataaaattaagccatctatgacctatcaactaatattgaagtaatgaagcttcattctctgtagtttggtgatgctagtggcatacaatcacctgtttcatttggtggatttggaagcttgaccaggcacctggggagactgtcagctggtaagcctttcggtgaaattcaaacttctaatgtatacttttgaactagttgaagcagatctattgcaatgttgtggaacaggaggttttttttttatttttagtttcatagttttatttatgttttatctgtgagacatgaaactatgaatctgttagtttttctgagtattgagtgaactccccacctccatttttctttaccttgccttctgttttcagctacattggaacaacctagttcagtaaaatataatgtggctgaaacagatttaggaagttgttcaaacaagtaacagctatcaacaaaaaataggcacattattgagataatctgattctttttttttccttcctttttttcactttattacaatgaaggaatacatgaagcaatcaatggtgattatcttgactcatacagcttgtcactgctgaatccttatatggtactttccaacttctctaaagactgtttcagcaactgtagatgaaactaaatacctggccaatattgtgtataatgcagcccaacttgagtgcttcatggttgttccaaagagcaatgtcagcaaagaaacagtccaatgttcccgcagattttattaatgaacttctttataccaattttagttgtatgcaggtagtttatttctctcatgactcattataattttattctttcttactgttgcttctattttatctatcacttctgcagaggcttggtgatccagtgctccgaccatttctacaggtggacttcttgtcccggtctgaaactctggatatgttttttgctttgtatttgtgagatgtgcttcccaaaatattcatttaattgagatgagaactaaaccaatatcaaatttcaaaccgggaacaatgactgtcctgagaaattatccattttttattgcaggatgttgtacagtttggtccactttccaagacattgggcctggttatcttaacaaatcctaaaatactcccatccatattcaaacaggtaattcatgagtttagctatcagtaacttcttatttccttttttcatttcaagactgcaaagatgaataaatacctaaaaactgaaaaaacatctcttcctacatgtttgtgctgctttgactgacatagctcataacataatttatatgttcatctcttagtttcttatgtcatttaattggacaaacaaacatctaacaactagttggaggtcaataaaaatatacggcataaataattagtgaagcaaccttttcaatataggggatttagcattttatctctttccaggttggtattcctgtacttcttgattggtccagacattttctggggcttggctactacacctttttatcgacctttgctgatcctattgtgaggtaaaagtctttacaaagtccttctaaaccacttattagcttctttacttattcaacaagcatatagatataggtccaactaacacacccttatattctatgcacatgttctatttgcaaggccatttttaaatacattaccatccaaggcgagtttccagtggaagcggcatctcgaggcttggaaatatggagctggtcttgattacaagttatagtaactacttttacatatgattcaaacaaacctacaaaatagagatgatgtggtggcataattggtttttccctcacatccaatttcttgtggttcttctcaagatttactcttcatctcattcgttcttgatcttcaatggaaacgggaagttttgattcatctttaccacttcaacatcaagtgaggtgacataaatgaaaagtagttttaagtccgagatatatcatctaaattgtccatagggtgttccataacgaagcatggaaagagagcaccaaatcaaatcaaatcactaatatattagccttgtaagaaacgtcatatctatactttctaacttatcatttgcaccaatgtgttttccgtccccaataaaatgagatgtttataatacgtttcatcaaaatccttagtgagcagtatgttaacaccatcaatttaataaataaacaggcatcagtctataaaaatttgagttttacaactttctatgaaaagtgattataaacaataactttatgtataaagaggtgatgtgtctacgtttttcctcgatgaacaacatcaatagcagcatacagcattccttacggcacttaaatggtggattataacgacaattacttaattatcattaatatatttagtgaattcaggactttctttgatatagggtccattttaaacttatttgttaaaataatgttttttaaataaaataagcatttttttagtttgtttaaattatttttacttaaaaaagtaatttttttttcaagaagtaaattctatctatttctaaaataacaatttctaaaaaagtattttgttcaaaattatttttttaaaatttaaacaaactaactcttagtcatctcatccttataacatcttcaagaagcaatgcttcctctgtttgttttatctaaatctattaatttatatcaaaattatttttagcttcctaaattaatcttaactatgctttcatttatacgtagtgtataaatatttaaataaaagtaagaatataattaaaagaacaatagtaattgatattgtcttaagcgagttatttccatcatgtggccaaagtcataattttgaatgcaaaattgattctattaaattttactaccaaacatgttagatattgatctcacgttgccaaaagtcatcttgttacaacagatcatggttttcagaaccttaacaatatgtctagtctgcttgaagaaacaaaaaaagaattgttgaattaaccaaaacaaccatattccgcaaattattactatctgaattattgacatacacactattttgcattatttttactctcctgcatgcttcaacatatacggccataagaatcgccagagacatactccatccaaattatctatgtttggatgtccatgccactatttccaaagcaactaaagtaaaaggaaaacaaataaaattgtagatctcaatctgttctttttgcaccccaaatttttgacagctcctttatgatagtcttctgcttaacatcgtccctttccatatgccactttcttgacatattctcagcctgcaaatccaagttttgagttaggcttatgaattgaaatattcagaagattaaagaaatacagtttaaaacttgcccatatctttaagggaacaaattgctctttgatattctcaagttgtggctcaacatagtcttttcccttagttttgatgtcactcatctgttacaaacaacaaaaatttccgataaagaagttaaaaaactaaaatggacaatttatttggcaatatagagatctattaataaaactgaaaaaccatagaagaaaaaacagtatcaatatacaataccaaaggcttatacgaggaagttttacggttctaaatatgtcattcaacatgatgaataatttatgaagaatggtgaataaaaatgcagcaagttaggcattcaagtgggttacttgactaattttaaagcatacacatgtattaagaaagggagagaaaaattgcatataattgaaatcacttacattctgcagctctaacttggaggccaccacaccaaataccaatgcaacaccaccaaatacaaatgcagtggcaacagcaaacgcctttccaactataaaattggaaattaaaagttgcattagcaaacataagcatcataagcaaagaatttgccaaaaacctattttttttttttttcttaacttcattattggtataatgagcataaaaaaataaaataaagtcatatctaatgaactaaacaaccaactgaactttatgtacaagcaaatcaagtataaaaaagtgaggttattcccgggcttcactatcccaaaatggtaggacattaatgcattgtcttcatagacatggtatttacaaactaaagcacaaaaccttacatgtatcaacagtgcaacttctggtgatagcaacaggactatagcaagtgatattgtgtgctataaataactatgacccccatatgtttctccttgagttcataatccaaagcaggtttctcagggtgctgattataactgctaatgccccactttagtttttcatattctaaatcatacttagtccaataacagagaaaatgatgcctattttggttttatttattaaccctattaccacacactcaaccctaaacctttttacaccagaaaagtaacttctgcccaaatagtatcccattacttcattccccataaaagcaacatatattgtatgacttaactccctctccctcctcctcaatttctatattcaaaatataaaacattctaacctcaatctcaaactaaaaggtctgtcttattgtaacactcccaacaaataacaaaacattgcttaaacagcttaaagctctatacttgaggattgctcacttaaacttaccaatattgctaatttaatatcacacacaactacaagttttctactgttacagggaccctatgaaggtttaactctagctcgtttagttgatgagaaacttgaaagtatcacaagttcccgccctcaaattaattaatccacactctacacccaataaaataagattacctaatctcccccaaaacctttcccctttatactaccgcatcaactcaaactggttggaccaagtttcttagtagccacacctgatgctgaatatattggtatttcaactttgacatatttggtcaaagttgaacagagtatcacattctatagagggatcacaggatgaccataaattatggtgggccttgtctacaccccagttttccttaaaccattatctgcaacagattccactataaagtccacagagacaggatgaggttatgtgaaagatgaagtaccaaacctaatatatgtaagtttgtcaagtatatagagtcaacaatgtacatattcatcagtgagaatttgcattagagataccatccatcttagaggaagttaatgagatgaaaatgtaccatatgcaagcccttcacctgcagctttcaacttctcggggttaacatgggtgctatatctgtcttgacgcgattcattagctgttgaggctgaaaccgtgtttgctgcttcaggcagttgccacctgtgtaaccaaaccattgtgcataaacaattgaacaaacaaaaccacccattataaacattagaaaagaagatgaatcacaatcagcttcattgccctattaaatctcaaattataaaatttaacagagtaaatagcatacactaacagtgtaaaggatttttacaatatcatccaatgacaggccaccttatttgataagttcgttaatttttaccataattataatcttaaaagtcacgcccaacgatgatttctgattaattgagagtatactaataacacacaaaaattaaactcaatttaaaaacaaaaagttgaaattcaaatgggaaaacattatgcaaatgaaatttgattcataaagtgaaaagaactggggaattgaaattgaagagtgatgaaggaaccttttggggccaaaggagacttggggcagggaaaggtaagcacgcagaggattgagagcatcaggggatacggaagattgggttttggggtcggaatgaaggacccatttggaggcagagaaggaaaaagaggtggcttcatcatttctgaacactttggaaggaagagagtgcctcagaacctcgggaagtacatccgcatgatcatatccttcgtgaatgttaaggttgttgttggtcttaggaagagggtttttttgggctaattttcccacggcttgtttggattcctggaaaaagtacgcagcttctttcccagctaaccttcccgcgagaaaactcatcttccagattactctgttacttttgtactttgtactttcttcccaccgtttcattacgtatttatatggctcccaagctatctactttattgaatttagttgaaaactgtcattaattacaagagtagttatattttcccaataagaaatttcaaacattcaatcaataattttcttttatttttatctttcttttttctatcacattacatcaattaaatatatcacttatttatgatcttttctttctctttcaagttataacaacaaatatttttctaattaaattttttcatatatttgttttatccataataatcaaaaatacattagtcaaacaattaagttaaagatatattattgtttaattataaacaatgattgacacaaatgattaaagatttgaaatgtttcattttttatggatgagttagaatctcctaatttgtgatttaggtctgtgcaataatcttttaggtgtatctttgttgatagtttcaacatgtcattagtgtcctcctccatggaagtgtatttttattttatcattttatttaactaaaaacaaatctgcttcaatttaaaattattaactttttaataattattttaaattttatagtaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctttctaacacatgttacttttttaatgtctaaatacatattacttaaaattattaaaaattacaaaattaggaataagagtttaaaaagcaaataagatttacttcctaatttttttataaaataaacttattttaaataaaataatttagacatacatgcattagaaatgttataagatttttaagaagaaaaaaaaacttaaacaaaacctagaaatttttgcaattttccatgaattttaacctataatgtgttactagcataacctttctctaaaatatatcttaacacgtatcaaaacaataaccttgattgttatatatgttgtaattcaggaagatcatctgcaaaagtgataccgtgtaaattgctttgtataataaaatgttcttattttattgtatagtattattgctctactttcaaacagaaatgttgactataactctataagcagacccgagagcactaaaaaagattatctaattacttgggaagcaagaattgtgcacatccctattgcagtattgcttggagataagatcagtatgcttggagaaaaagtttcagtttgacatgctgtataacaaatgaaatattttttatttttttccatctatataagaattaaagacacgtattaatttttttttataacagtttattcttttctaccaatcgaataagatccctttgataaatgagatggtcttgatagattttggacaatcaccacatccctattacttcttcatattttgcagaacgaaaataattctaatgttattattctatttgatttttttcttttgtctttaataggtatttccatagatttataatatattcgtaaatgattgaatcttagaaaataattatacttgtttttcttcaaaatatgaagaagtaaatatgcttttagttatgagattaattttttagatggaaggtaacgattaagtttatctaaattcaaactcctactgttataagtaaaacttatatccattgcagtttttgacactctgtaccctacaacaacaacaacaacaacaaaatggctattgagtaacgttgatgatagagagagaagttgtaaagttgatagtacgtgccagtaatgcgcaacttaattctattgcagtctgtgtgcacgtgtttgtgtgcgtggagattgtagacataaaattatggaatgaataattaccaaaaataaaatttatactacaatgaatatgtgtcggtggtacccaacttagttttatagcccatttattttgtgacaatttcaaattttatcgtagggtgtgtttttttaatagtaaattatacttgtattttatgtgtttttttttcaaattacatttgatatattttttttatacattacttttacatcattctattaacatcattagctaatgtcaattgaaatatttgaatagacgaaattaaagaaaattatattaacatctcctgtgtttttttttttttttcaaattgtacccaatatctttccattgaatctaattctgacgaacatgtcaagattattgatgtcaccgactccaatggtgtcaatgtccagggaaccagaaccagacgcaccggtgatggtgcatggctgaagttacgatagtggatgaggaggtggtaaaagtggatatggcagtggtgacgactgctacaaaggtggcggtggctacagtggaggtagtggttgttccagggagagtggatgcacccgaagagaggttgctgctgtgggagagaaaggaggaggagaaagaggggggtggtaagtgaaaaggagttgttgaagaagagaagagtttatgaaatccaagatatgattttgaagatgaagatgagagtattttagacataaattttcattaaaagttgtttattttctgttaagttattaaacggtatttaagatgaaagagatctgactgtaatatgagttaaacaattaagagatttttttttaggatgaaaaaaagaaaagtatcaaatataatttaaaaaaaatgtagaaggtgcaaatataatttacacttttttttcattccgaaactctataggcactagtatgtgactctctttggataatgaatgactaacaaaagagactaactttactgatataattcaatttcagatatctactgtttcttttataaaaaaaaaatcaagaattactatcacaacatcccacaatttcaatgaccgaattccctcttaatttatacagataatagatgtggtttgtttatctaatctaataagagtttgtctagttgactcaaaataaaaatgagattaaaattttttatctttaagatatttgtcttattattaattttattattaatgtgattattactatatttaatgtagcatcctttctctctcatgttattaatgtgattgaaatataacaaaagcagtttttcaataacaatttacttttatattagttaattacttaacgtctgataattttagttaaaattttgaacttagctcctaactttttaaccactaagaaattggtttctatatatatatatatatatttcaatcactaagttataaatattaataattacgttaatgatagaatttaaaaaagacaaatatctaagttcaattagcttcttcattccgcctctcattgtgaaacacaaccttatttctctgttcccaaaccacccccaacttctccaaaaatcctctcctatttagaagtctcctccattcacattactgtttttttcaatttgggagtggtgacaattgtcttcaaaataatctcttttatagtttcaagctctaattattgtctcaaattttcaacacctttgaaaatcgcatcctcgttctttcaaagataaaatgttgactttccaaaagtcaaaaaagatattccatcaacttccaattcgttagaaatttaaattgatttttccaaaaatctgttactcaattaaatttccaaatctcatcactagctctcatgtcctgcgcatcgtgcttcaactgcaaaaaatcttattatactccctgccatagttttgattttattattcatttatgagtattaacactatttgtacttgttgtaaccattgttagttaccactaacagaaaacatcactaacagaaaactgcacaaattatcgtctctcacaaatctaaaacctttaaaaacctcaatccctttcattcaaagataaatatagatttaatttcttcggatcaacaaattccatcaatttacgatacattgaaaattaaattgcttttctggcattttatccacacggtgcaattggcacatgcatgctggttgtttgccatgggctttaccactctcgtgaaccttaggatcgatggcacagggagcccctcattagcactgtacccacctatgagtaataataagagtctgccactagccatgtgcatttctataacaatcaaatctgctgttgacacaaaataattactattttctagctatgaataattaactctagcagggattcaagcttctattttagccctgttcagataaaatatataattggggtttgataaaacttgacttattgccaagttatctagctaaacttaattgtcaaatcattcttttaatttcctaattgcacatttgttgaataaaatcagtaaagaggacaggatatatagcgatcaatgatggtaaagaaaataatggtgatgataatgataatgatagttatactgttaataattatatgaaagaaatgtggcatagtaacaattatattgggtcttttgaaagaaattagaacagttccacatgtaaatcatgcttgataaaccatgcaaacttgagataaaataaaggaaagagggtgaagtgaaaaaaaagtgagttcacatttcactgtgttgagacatgatgagggccggataggttttatattactatttataagacaaaatgatttatttttacaattgacaacaaaaagttaaagtatatttttagaaaaaattgagttaaaaacactttaaaaaattaaattaaaaatgaattttagagctccaacaaaaatccagtgcgaaacttaagatttaacgtttggcagccacttatatcagcattgctaaatagttggcaaaatatgtctagaagttaatagcatcaagtttcctaatatcaactaacaaaagatcaaagctatatctgtctatatcatatgtaatattaaggttttttttttcaccaaattatgtgacatttttatttttatttttaaattgtttaaaataattttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcaaataaacctatgataaaatctatttaccattaaaaggttgatcaaatcttaaaatatttttcattttatatttttaatataaaaaattcaaaagtgatgactattcaagattccgtactcagcatgtgctcttaatgatcacatttacaaatcatttaacaaaaagtctattaattatcacaagactgttgaatgatttgcgtgacaaattaaaaaattatgatggtttcttacacattcatccttagtttaagaagcatgtctgcaattttttttttttaaaatactttcgaacattcatacaaatatttctaatgtaaatctcataaagattgccattttttaaataaaccaataattaaaaaaaatatttctaaaaaggttaagaaattaaaaaataaacactaaaaatattatatatttttaaattacttgaaccaggttctttaacaccgattttcacgtaatattgattaattttaactaatttttaatttaactagtttgactatttttttgctctactgtttttttaattaaattatgtagccagcacgcagtctaacctatgttattaaaaattatgaaaaatgtaataatagactagcagggaagctcaaataaggaatctattactattaccgtagctagcgcgtggatgggtcgccaaagcaatcatcaatattattttatgtgtttaacaagaaattattaggtgatttgaaattattataactcaattaatcagtgtataacttgtaatgaaatttattaattctttcttatagtacaatgaaacacctaaatagatgttacaaaagagattaattaggacaataaatatgtgatgatgtgatactatttatttctttcatcttataataattgttgtgaaaaagttattttaaaataattttaattttaattttttaatgtaacatcaattatactttatgaattatatctcttataatattaataaacaaaaattaaatgaattaatagtgataagtttatttttgtaattctcttctatctatttattagattttattggtctttgtgaacgaatttaggagacaattataatattatgaagaaaataataatttttttattaacatgtatttattatttagaagtctagcttaattaattaagtaaaatatggatgatagaaaagtgacggtggcatggccaatgttaattggcaattgacactacctctcattgagtatatccaacaccaacatattatgttactactttttattttattttccaactacacaattatttcacacaaccatggtgttcaaaaatcaacacgcgcacaccaaaaaggctatagctggagctggtggtgcccttggtgggcgtcctgtaaccagaattggtatatatgtgcacttattccacccctgtgtggaccacaaaccccaccttaatttcacaccaaaaccaaatagcttcccatatggattttgtgtgcatgcaactatggaagtgagatatattattatacactcactgtacaccatatatacttgtactctttttttttttttttatcctaactaccctaccattttggagaaacaaattagaagtgaaaatataaaaaataaatgtacaagaggttctgggaccaaaatattatgtaggtagggtgagactaagaacatgtggagtctatcatcttctggcaacaaatattcttgtgtgtgcacaatatggtggagttttattaattatttgcatggttgttgagtgaagtaatgggtatttaacacagtgcattcaaggtttggggcctatgacatcagaggaggtataatgacttaactgtttgatctttgatgactgccatttcattttcatatattaattttgaactcaaaaactcaaaagcaacaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacaattgaattgatgcgaaacccaaaaaatctgtgaaaacctgttagtcaactatatgttctatattcttcttctcaacagttgttttcaagacataggcagaggaggaccaagaaaattgaaaaatgtttgctaatgtctgatggtggatcccaaagtttgaccaacaaaacctcaaatcttagcagtggttgcccaagaaattgtaactcatttgacatgcaaccagttgtgaattatggagacccttgtttgattttgagccatggaagaagcaaaactatgattgtataatgaataaagcatacaattgcgatcttaaaaaaatttggcttcttcaattgcaataaaacaggaaagtttggttaaggcaaagaaaatgtataaaactgtatacacaaactacaatttataatttattgtttcatacttcctaaaaactcaaaatgctctctttaccttctgtacaaggactctccactaatctagctaattaattaacaatcatatttctaacatgacttaaaaaatgcaacttgaattctgctagcatataatataacatatatattatatttgtatttccctgtatataacaaagaaggtagtgaataagaaagaaaccatatctgattacactatatatgttgctgttgccaccaaaatctgagagagatcaagctatctatctcttgttgtgtaaagggttggatcctgttggcactctgcgtttgtcagacataaactctctttctctgctgcttcggattggagaatttgcccacggatgaaaatcttgatggcttgaagttgaagggcctgagaatttgatcctaatggcatgaatttttggtgtaaggaagagaagagcgaggaagaggaacaagtggaagtgtttcatgttcgtagtttttttttttagtaaggcctcggagaaacaaaacacgaagtgatggaaatgcaaaagtttggtgtaggctaggcttgtttatgttgtgtatatatttatatggacaaggttaggtccaacatgtgcatactaaatctggtgatatttatgaaaacacttgtggtgtttccgtgtgagtttgggtggtggggcatggcctaattgccgtgtgattgtgatcaaatggtcaatgatagatatggggatcagggggcctagaatgccggttgtggggggggtggtgtggtggcaatattcaatgagatagtgacagagaaaaatgaacacgaactcataggaggtgcatatatgatgtgaaagcttgaaggcaagaagggtctttgattttgtattgtgaatgaccaaaatgtccctgtttttggtttctgaaagaatgaaagcacgcgaagtatgataggggcgttttcgtcatgaaaagtcaaacctcgccgacgcactcaattggccttgttggaacagcaagcagcgagaggcatgtggcattgaaatagtgctgctatctaattaatcaaatagaattaaaataataaacatgttgaaagggaactatactagattactagttattaagcttatacacatacacacctccataaggtaggttaagtagatccgtatttgctgggtctaagtcaaaatgtagattttgaggactggtcgattttgagggactatatattgttcttaattcctacccaccatgcaaacttatgtaagaattatagtttttttttttttgttttaaattggtttttttaaatattagtaattgtaataatattttaataattttttatcaagatattgatacgaagtaattatgtcaaaagtaaagactaatatttattaagaatatcatgaacacacaaattgagttttcaacacgatttattttatatctaaggattagtcaagatttgaagcttggattacttgtttaaagaatataaacttatgttaatttgttgataatactttgatgatatttattattaatttaataattcaaataaatgaaataattattgtatttatcatttttttggtactaaaaagtacccaaaaaaacatgataactactttagtctttttctttagaaaaaaaaatactactttagtctgtcataaaaataaatgggagacgttttaatttttttgactaatttaaaagtaaaaagatatttgtaatgataccgtaatctctttatgtatagtttaaaaaatatttgacttattccgctaacagaccaatcaaaacctctcccttcttctattattcaagatacaatagattatgggtctcgtaatgctaatagtcttgtattgaatcattgagccatgtataacgcatgtaattatagtatcatatatttaaactgtaccaaaaaaagtatcatttagaaaaaatacatgtcaataaagaggagcacgaattgtcaatgttaaatctagtggatattgatgtatcttcttgcacgggtgagaatagggaaaggccaaaaaaggcttcatcctgaagcgtctcggtgaaaactcgtttttatgtggctttttagcttttggtatggcaaaagatgaaaccataaataatgagaagaagtactactttcatgttttgtgttgtgacttagctgttttacactcaaagctgtaagcattcctcaaaagggtatgtatatgccttatagttaagggggttaggttgggcgttaattcaagtttaaatgttggagacaattcaatagtcaagaattccaaaagggaaaataaagtgatagacaattagtagtttagagaaagggttattgatttgaagaagaaatgcaagttccttggcggaaagttatttgcattatcttactaacaaacaaaatggtgatccttctttattattacgtttagtggtttatcataattcatatatagcatctccaatatgaagtgcgagaaaaccacaagtcatgtattatattattcataaagttcaaagagaaaaaaataatataagaggtcaatagatgcactttttaagcttgtacggttcaaagctattgttttctcatccatacaaagtaagaaattaaaaatgtgatggcactgaaattctgtggtccgcccacaaacgcagataaactttcaaatatgtgttcatgggagcatatgcatttttttttcacccacttttgaaggggcatgacaaattgcattatattatcaattttactattctataatgtaataagagtaattaaatctaattatgtaagattaattttagcggtcattgtttaacgaattacttatttttaaatattgttgtttatttttttatcattaaaaatggtttacgtattatattagattatttaaaattaagttctgattacttataaataaaacattttttttgccgtttgaaaatcattaaaaagaattaataatttaagaattatttaaaattatatcattaaagtaaaatatataagttgtttaattataatgtaacattttaaagaataattaatataagataaaaaaattaaaataaattatttaaatttcatcacccattaatacaacactaatattttttaatttcaaattcaaaacaatgcttatcgtatcctcttcaaattcaagaaaaataaatgagctgatattccaactggaatgaccccacacaaggagttaatccataccatattatgcttttctttccaaatttcaagttcatcgacatgttttattcataatgtatataactactattcttatgtaagggacatttatgagtattattagaaactaatgagtggtttcatggtgattcaaagtattattttcatagctttcacatacagaagaattaaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaataacaattgaattctatactaagttaacatgtgatttagcttatgtaaaacttaatatcaactcttacaactagacaaattaaacaatttttaaatatcttggttcatttcaatttatttattttcttaatggtgtgtttaaaattatgtttcacttggtgcgtgtattaatgaataatgagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcttgataaatctaatggttttaataagtcattaatcttattgatgagattataaaaaataaatgatgaagatgaggaatatctctaaattaaagaattacttttttgaagtaactgaatatatatatatatagttggattatgctagaaagattttaaattttaggttattcttgtaaatatttttttaatgtaaataccaaaatatttactataataaacttgcattacatagttgaaagaaatcatatttaaaactgttgaaaaatcaaggagtaaatatcaaaaatatttatatcaatgagtcatgatcaaattaaatttgacatcattttttaatacaaaatcttaaaatttaagtttatagatcttctcttcgatgctcaatttttttatttttatccattataaaatttcatcttgcttcaacaaaaattaataaattaaaataatatatttcaacatactttttaatcatcactaaattaaatatttcacttatatatttatccacacatcacatcacgtaattcatatatatatatatggttatatttataaagaaaaatctaattatctaaaagaataaagaaaaacctaacgttaattacttagaaaagaagaccatatactacatcaataatttaccagtaccgtaccagactatatttgattgatatatagttgtatggaaagtcttatatatgataagataggttgtacattattcatctctctagctagcctgaaagaaattgctttccaattattatcgattacaaattaatacaacccggagcatatatagttcatgtcctttgcaattgtacaaacacatgcatggccaaattgaggtacgttgcctcaacacttaagagttggaaattaaaccatatactttttcaattagcccttgcatgagtggattacttgcaactgcaagctgaccccgatatatatctgcaacaacgtaaaacggtccctactgtttgggttcacatgcacttacctctatttaggaggaacaaaccaaactgtgtttcgaggtaactcgatttaacatcaatgttgtattatactaatatctgctgctgaataacctttcgaacaatgcttgcgcaagctagtcatcaatatccacaatatttggactaattaaagagaaagaaaactaattaaaatataaattagtgaaattcagaaaatatgatcaactctagctcatatgtgtaagcaagtaacgtttcatgaatttgaaagatcatcacatggttatatatatatatataaacataagtattttgctggttgaaaaatgtgtatatattgttggagtagtagcaacgttgggtgtggcatcaagtccactagacctgcaaggcatcgtttactttgtgcggttgtttgtgactgtgatcagaagtcactcgagtggtttgttgaacaaagtttacttgtctttaatctttatgattccaaattacagataagtcaacccactcggattgaagtgctatatatatatatatatatatatatatatatatatatatatatatatattaagttgttggttagactataagttaaggaggaattttcatgagtctaggcctaatgaactttcacctaagcaccccatttcgtgtccccgatcttcactattttaacctaaatggtagccatttacacgaccaaaaagactacaaagaagattacaaacaatagttcttgtgtggttaggtaaggtttatcatattgaattagtatattaaatttggtaatctaaaaaaaaacaattaaatgaattcatattagtttgattacatggttgattttatttctcttgtaatacaaattaaatcaattatttttggcttgattcgtatatttaactatttaaatttaaattaactcaccacctaaataattatttagttttaaactttcaaatttatgtatttattatctaattttacaagtatcttaagttatgcttactatttaattttttttataacgtatgttttaagtagaaggattaatgagatatataaagtcatagatgtgaaaaagttatatattaattaaaaaatatcaatacttggaattgatttaattattttctggagatactaagaataaaaaatatttaatttagtgatataaaacttaaaattctatataagaaaaaaaagatgtacaaaaacttaaaataatatatataaatttacttttttgtttaatttggtatccaaaccaaactaatacaattaaatatcacacgtatcattattagcttttttattttgtgattactctacttaagttaattttgaagtatttatataattttcattttcatttttaattaaaatgttaataaaagaaattacatattttctaattaaataataatatcaaattatggtgatacaaatcgaaggaaatataaggtttgcttaatgataaaagaagaagaaaggcatagagaagttgtggacttgatgattttgaatttttcactaatagaaaattaacacctaataactaacattgacacggataaaaaagaatggtgattcaaaataaaggacatagacttaagctttaatttgggatttcaagtttggaccacatatagcccaacaaaaaggaggcacccaatagaaaaaggggcaacagtgatgggtacgtaaaaaggtgcaacttgactgcagctgtataaaacagctatgtaatgcttcagagcaactttccttaatatgagataataataattaccggctttctttttttggacagaattatcggctttcttaatacatcattacgaacaagtattctcctgacaattgttttcaaggatgatggattgcatcaatctattgatctgtaaccaactctctaatggtaactaatgaatcaacaattcctttaatgtgaagaatatatttagagataggccaagaatgtttatatatatatatatatatatatatatatatattttagctatgaatgaagttgacacatttttgctccaagttgggagtagtaatactacttatatatataatcatgtttaattttgttcaaaagaagattctattgcggtgcagcaccttctgtgcgccatcctccaaaactgaaaagaagattttaatttgacaataacatcttggcgccacattttatttttgcttttcacatgcttggattactataacattcagaatgattaacctagctagtatgccatgattcaaagagagacacgtaatatgaatacagtaatatatggaagaaacaaagtgggtggtccaaatcaatgaggagctcaatagtgatggtcctgcagcacctgagaagcaatgggagacgcattctatttacaaaattccctcacatgtcactgagctgaacaaaaaggcctacaaaagataaattaggaacaatggaaaatgtagaaacttaccattttcattttcctaagttctttcctacccatgtgccccctccatcggcattgtgtgacaattgaatctttcttgagcttcttataatatgaagcagctttgtggcaccgccaccgagcctgcaatttttcgagaattaaaatattgaatactgatgacccttatcaatgctcctaatcatatgttagccaactgtaacctgaataatgatggaagctttagtctgtttcctaaatctgaactctttgaaggaagcaattgcccttaaagctgtttgcaaagtaagtactgatgcttggagtttaatataggtattcctagcttcatatctgcgcatgttcttttgaattttcacagcagctgcctccgttctcttgatggtggaacatgatgtggataagaggtctattttcaaatcctattgttgaactacaatatagaaatgctaggtagactagatgggaaatattcttagtaaagaaagattcgttatgccatttttttattaagcagtttgttttcatttgtaaactgtgtaggacataccagaatacccttgagatcaatatagagggaggtccttgttcctatcatggatgagttcagccagctcaggtacatactttcctgaaaataaatagttgtattatttactattaatttaattagaataaatgatgacaaaaaataacttatgcaaaataataggtatttcaaatttcaattaattcaatacctgcatagctctccccagctatgtaaaatgtcctacttctatatgacgtcaaggccggcaacattctactcgacaccttcgccgctgtcaagctctccgacttcggtgtcgccacttgcttgtacgttgtgttgaaaaagcacaccgaaagcagaggcgaaattttcaaagtgcacagtaactttttactgtgcacatgcgttttcagcttctatataaagaagcgaattcattcggtttcagtaggtgcagcagcagcagctgcatcccacacttgagttcttctcttctctttgataatattatttgttataatattatttttgagtgtaattttgtgaggagtattccctagttcaagagagagataaaattgttctctccttgtgataaaagggaggttgtagtgttggagttcccatagtgaaattttttctactcttgtcagtgggtttttacctcagagttttcccacgtaaaatatttgtgtctatttattgctttcaatttcctttatctgttgttattgttctgtccgatggaatccggtttattaacagtggtatcagagccaaggttctttcttagtatgctctgtggctgcagcttagactgatctgtcacaccagaaaagaattatccttgggagttgctggattgacatcagtattaatttatactgaggtgctgcaggtgttatacagagactattgctgtatacagttactgttcgcaatcggagcattcctctggagaggtattttggatgataaagtgtgtgtggaaagttttgtcacaaagacgaaacagtctaaggagattgggtattaagtgggaccactagtgacccctccaatctttcctggaaactttcctggtgcactttccagaatactggttgaaggagaccgaagtgaagcagtgggagttactttgcagcaaaagcatttcgtgatagaaccatgacaacaaaggtagatattggcaaatttgacgggacaaagttctcgttgtggaaattgaagataagggcaattctgaggaaggataactgcttagctgcaattgaagacagatccgcaggggtgacggatgacaagcagttcaagaggacagacaatggaggagaatatgtagatggcaactttctggtgaccggctcgacttggtgaccggctcggacaagtaagaagacagttgtggatccatggacatgagatccattgtatcgaaagtcttcctggcaggtgagtccatgcatggaggccaggcagcgagtcccgcaagtgttgcggcggtacaacgtactaagagcataagctctaagagccactacttgtgaattgaaaaatgtcttccgcttgagggagagatgtggaaaggaaagccagttgattattcttctctacatgtgtttcggatgtcccgcatatgtaatgtacaactcccaagaaagaaccaagctggatccgaaatccaggaaatgtatattcttgggatatgctgacggagttaaggggtatcgcttgtgggatctcactgcccgcaaggttgtggtcagcagagatgtactatttgcagaaaatgaactgcaaagggaacaagaagatgacagcacttcgaaggaagttactactgtagagatagatgggaacaacggagaagatgcttcctatgaagctgaaccagagcacgaggtggaacgatatcgtgcaagactggtggttaaaggatatgctcaaaaggaaggtattgatttcaatgagatattttctccagttgttagacttaccactatcagagtagttctcgttatgtgtgctgcatttgatttacatcttgaacagttggatgtaaagactgcttttcttcatggaaatcttgaagaagaaatttgtatgctccaaccagaaggttttgaagaaccaaataaggagaacttggtttgcaggttgaacaaatctctatacggtctcaaacaggcgccgaggtgttggtataagagatttgattccttcatattaagccttgaatacaacagactcagttcagacccttgtgcttatttcaagaggtttggaaataatgatttcattatcttgctgttgtatgttgatgacatgttggtgacaggccccaacaatgatctgattcaagaattaaaggcacatttggctagggagtttgaaatgaaggattgggaccagcaaacaagattctagggatgcaaattcaccgagacagaaataacaggaaaatttggctatcacaaaagaattatttgaagaagatcttgcgacgcttcaacatgcaagattgtaagccaatttctacccctattcctgttaatttcaagttatcctcaagtatgagtcctagcaatgaagcagagaggacggagatgtctcgagtaccgtatgcatcagcagtagggagtttaatgtttgctatgatttgtacaagaccagacattgctcatgcagtgggagtggtcagtcgattcatggcaaatcctggtagagagcattggaatgctgctaagaggattcttgagatacatcaagggaacctcagatgctgcattatgttatggaggatcagaatttactgtcagaggatatgttgattcagattttgcaggtgatcttgataaaaggaaatctactacaggctatgtgtttactcttgcaggaggagcagtaagctggttatcaaagttacagactgtggtggctttgtctactacagaagctgaatacatggcagctactcaggcttgcaaagaggcaatttggattcaaaggttattggaagaacttggacacaaacagcaatcagtgattgtgtattgtgatagtcagagtgccttgcacattggaaggaatccagcctttcattccaggacgaagcacataggagttcaataccattttctcagagaagtagtagaggaaggttgtgtagacatgcagaagatacacaccaaagataacctagcagatgtcatgacaaaaccaatcaatgctgacaagttcatatggtgtcgatcctcgtatggcctatcggagacataaacagcatggaaatggcaagatagaaagaactgtgtggagattgattgattctcaatcatatctccaagtgggagatttgttgaaaaagcacaccgaaagcagaggcgaaattttcaaagtgcacagtaactttttactgtgcacacgcgttttcagcttctatataaagaagcgaattcattcggtttcagtaggtgcagcagcagcagctgcatcccacacttgagttcttctcttctctttgataatattatttgttataatattatttttgagtgtaattttgtgaggagtattccctagttcaagagagagataaaattgttctctccttgtgataaaagggaggttgtagtgttggagttcccatagtgaaattttttctactcttgtcagtgggtttttacctcagggttttcccacgtaaaatatttgtgtccatttattgctttcaatttcctttatctgttgttattgttctgtccgatggaatccggtttattaacacgctgtttgggcatggttagcatttgccttgttttattttgtctcaacataacatgctctatgttgtcattaactttctcatgcctgcaggatggctcctgaggtgctgcaaccagctggaagtggctataattccaagtcagtcagtcattcattcagttcttctttttagctgcctctgccaattaattaccaaaaccctgtattgccatttatgttactgttaactaactcaaaacacatgattattgccaatgtgttttagcattaatggcatggctagtgtattgtattagtttcaatattgtgttgttctgcttggtttttaaatccgttcaactgatttagggtgtgtgaataaatagtttaatcggatgagagcttattatatacttgactgtgaactgtgaagcttgttgaattgaaataagctgaaagagcttattctaataagcttttccatcaagtttattgaaacaagttgttcaattgactgcaaaaccttttttttgtctttactaggattaataatggtatgggccaagtttattgttattgccgatgtgcataaatgttgacagggctgatatttggtcttttgggattacggcacttgagatggctcatggccatgcaccattttcaaaatatcctccaatgaaggtatttacatccagtggttgttcagagacaatgtctagacacatgttaacattggacccattgaagtttatgtgatataatttgtaataaaggaaaaagagagttcacttttatttcatgtataggttcttctaatgacaatacagaatgcccctcctggacttgatgatcgagataaaaagttctctaaggtattgctgttctttctggatgcactgttacacaagagtcatcattatgatacttatagttaattttactggttagttaattttactgttacttctaacattattcgtatgttatatgtggtatgaaatgggaaagtttgatattgggcacaattgaaatgaattgctcatagtggtttattttatttattatgatgagtactgtggttattatgtatgtatttgtagagtgagtgagttttgactgtgggctgctcctgcctctgccgttggtcttatcttttgctgaaacttgaaattgaatctctctcaagcttccttttttaaaaggttagggatcgaagcagaaggaagtaagtaagaagagatgggagtggatttgagacaagtggtggcaggtgtcctcaccctcacaatgtttgtcatgcttggaaatatgatccaaagagaccacactttgataattcacttcgagtaagcacaccctctttttcattttcatttgcatttgctagctcacaccagaaacaacaatataactaaattcatcttaagaatgaaaaccaaagcctttcttccacagagcttatagatcccttgtttacactgacaaactagaactaggagaagagaccataattgttttcaataataacgctttataattgaaccacattccaatatctagcttctttgatgtaaggtaaatataagcttaatgcatataaaaattgtttctaataattaaagtggaaaccatttgtctgatttgtgtttaccctgtgaaattatgtagctttcagcaagctgcagaagactgcagtaaggcaatatggcttgataagaaggtaagaaaatgggcacgcaatcgtggctatgggaatttactttctggtatcttatttctagttagtataatttttaaactccaataatctccaatcataggaatgggatcttcctaatgttgtaccaatgtcttatatcctatcatttttttggtttgaaattctgatcacaccatcttacctcatagatatatgtcattcaaagatgccacttcaattttccaacattgttggtgaatataattctcctgaatatgaagactgcaggttttcgcaagtgtttctgccaggcgaacccccctgggaatcaaatttggagggtacatgccgaaaagcaaaggataaagctaaaatgagatacaatgagaaaaagaaaactcgaatgtgtgtggcgttggtatgtttagttttgattctaaaaaacatgtatgtgtttggttttgatgcttcgagtgcttgttgattagaagtctgcaatctgaatttgacttatccatggaattcatgtcatgttaatatttattctaatgcttataattggttactgtcttgctgacgttggtttagagctatcaatcctaagttcaaagatgaaaaaacacttgagtaacagtagaataatcaactaaataaattaattaatcattgttgtcctaccctgaagtttaatttgtcattatcattcgacatcctcattgtattacatggttttcatggacacaaaatattgaaagctgggaagctgattgagaaagttctgagacttgtgtggagcaaattgtaagaggaacttgaatcttcatttttttttaacttcaattttctcttcttgtttttgaattagtgctgagacaattcatcaaggaattagcaagccacgaccattgagaactgagatagaacaaaaaaggagtgcgtattctttttcatagctatgtcatggttcttatatttttcttttatatattaaactagatataaatttggaggaaacttttttaatatttattaaattatataaaaaatttaattattttttatattattaaaaaataaaattagctcaaatgttcacaatataaagcttatttattaataaaaaaataataaagataaataaatatggttactatttaatacaaatataaaattaattttgataatattgttctcgtgacgtcaaaaaacttttagcaatcagttcatggtgcaaaatgaatggggcaatactctattaatatgtgagcaagtttctttcgaagttttccacatttggagttgacaatcacgattccccttactgggactcatttccctattttattaatttttttttataaaaattaactcatacattattttattataatcatttttatggagatcattaatttaaaatcttataaaaaaatattgaaaaaatattctaacttcaattaaaaaatataaatttaataacacatattttattaattttacacctttgctgtgaaattaaaataaaaatgaaaatagtaacaaataacaaagaaattaattaatagtttaaatagtactctgctcagttatttctattgttacctattcttaaaccaatgatttgatgaaacgtattattttgttccatcttgtaattgcctatcatttttgctgtatattagaattatgtttatatgttgtcataaaaaaaatgttattttcaaattctttagaatttatcatttcgtaagtattatgtttatatgttgtcataaaaaaatgtttatatgctcaatatttgctgtcagcatgacatgatgaaacatgttgcaacgatagtttagtttatccttttatatagctgcaactaagtgatttttaagcatgatattggctatttaatcattttttgtttatcgctatttcttgtgggctaagagcaagtgtcttttatatatatatatatatatatatatataaattatatgatgggtgaaaaaaataaaaaatagtcatttaagacggtcgttaggaaggaaaactgtcttgttttgattttttttatataaaaaaagcatattctaagatggttattagagaaaaccgtcttagaaaaaacaaataatatttttttaaaaaaatattttctaagacggttgttagtaagaatcgtcttagaatgtgacattttaagacgattttctgtaaaacggtctatgaatatcacattttaagacggttctatctaaaatcgtctttgtaacatgcagttcaaatttttttaataatcattttctaagacggttgttaggaaaaccgtcttagaatttgacattctaagacggttcttcctaacaaccgtcttagaatcctcaactttttttttatttttaaaaagtcattctaagacggtttcggagaaaaccgacttaaaattcggattctaagacagttttgaaaaccgtcgtagaaaatcaacactttctatgatgttaactacaaagacggttcaaaaatttgaatggcttaaagaaccatcttgcaagtagtgtactttgatccttaccattatggtcaagagcatttgaaggccatggaagagcacaagcaccgagctcttatccattttctcaagaggtgcaaaaagcctattgagctcatcttccattgcatggatcaagtggttgaagagttgagagactcgtacagtccgctagatccaatttcgatgcacgacacgccgaggttcctgcaactgatgattcttgatggctgttacatgttgtagattttgagagccaatgatagtgttccggatgattatgctgacaatgatcctgtctatggtaaacacgggaaattgtatatcatgcatatatcaaaagtaacatacttatgcttgagaatcagctacccattagggttcttcacacattgattgaggttgaaactgacacaacccaggtaattctcaaatttcttttgcacgttcaagacataaattaataaagtgaaactctaagctataagtgtttgtgctgaatttgtgttttattgtttactagaaggcgtactaattaaggtagcatcgagatggatgtatgaaacaggtcttgagcagcatgctagtctcttcttacagagaatgtgcatacaaacataggggctttagttgaaaccttcttgtaccagaaaaaacatacggaacttgacataatagtttatcataattgataatgccttagataaaagtgatcagcatcttttcattatttggtacagtagatgaggacaaaattaattttctgcaaattttgaatagaaaatggcacggttgtaagtgatatagtttagttagatttttaaacaaaaattcatgaaattttgatttgattcgatttaaatataacattaaatttaaaataaatcatactaattttttatgattgatttgatttagtttcataattttattatctttttatctattatcataacttaacattatcaactaaatttaaataattattatatattatttaatatttattattatttatcataataaaaattaatatttatcttaattatgaaacaaataaaaattaataaattatttaatatttattattatttatcataataaaaattaatataattataatatataatttatttgatttagtttgattttttataataagatttaaaaataaattaaattataaaatatacaatttttatattttatttttgtaatttttatttaaatgatttttatttttttattgatttgacagtttataaatagtttgatttaattttgaatattcctattataaaatgggatcaattaaatgataaatgtttcgtttttctaacactttccgagaaaaaactttcaaagagaatggaaagactccgttttggtctgggtcgtgttgcttgcgttttaattaattttcactttgagaagacaagacatttacgcggttggttagattgtagaacctccaatgtcctacgcacataaaagctgttttgtgcacagcaccagagtcacaatcataataagagagaaaaacaaaacaactttcccctccctcttagatatcacctaaggtcatttccaataaatgatcatgtaagaaattttaagatgaagttatatttttctaggatttaattattagagatcttctcaagatttttatattgaaggaggtatagtttttagaaaaattcttaagatttatattttttaaaaaaatattattgtttagtatctcttctaagtcttaactaattattatggaaaagaaaaaaaaataaaaaaatgaaaaaaaaactagataacacaaacaacataataatataatttaaaacaaataataaaaataaaataatatttatcatcatctgatttgagtggtcatctgaactttttcatcttcttttagaaaagagattatatatatatatatatatatatatatatatatatataattatgataaatgacataatattataggtagaaacatataataatttcttgccgcaacatccccaattttgattgactgatttcgtcttcattgattactcactcaactctcctttttagatttatcctttaataaattacttggccccattccaaccaaaatcaataaacttccacaattccacgttgatagtattctttgacttccttgttactattggatcttagtgataatcattggcggatttaggatttttttgtttatgttcgcacattaatttggtggtggactcaggatttttttttaaatccgctcaaaatatagttatttttataacaaaatgcatataatagtttgatcattgttaacaaaccacctcaaagtaacaattcagaataacttgcacattaacacttcaatcagcagttcagaaaccacaagcttggtattatacaaaacgaaaccaaaaggatgactaattgcacattgacgagaatagaagagagagagagagagaaatcacctcgtagcgagccgcgacggaggacgggtcgggattcgaaggcggaagcggcagtgacagaggtgaggacgcgcaggtggtgacgaaggcgaaagcggcagtgacggaggcgaggacgcgccgaaaataatgttgtacataggggtgcggtgggtgatcgcgaagaggccatgatgggaagccggtgtcgatgcggcagacgacggtgtcggcgcgggatcggaggtggttgtggtcgacggtggcagaggagcctgaagatgcgtcgaccagtgcagagggctgagatgaggaaaaggtagtgtttttaaatttttttaccttttaacagatattataaaaaaaaaatccaaatgtttatgtccgcacttgcgaacataaacatacttgtagcctacatgtatggttttgaacggtttgttagcatgctcgatccgaaggacaacccgacccggtccggtagtcggaccggccgggtcggtccggttttttaaactttgcatgtaggtccgcccctaatgacaaccatctcatggggtcaattcggtaagtttctcatcttattctttgaaatatttctcatcaccttacttgagtggtcatctagacttttttttcttttttctaagaaagggataatatatatatatatatatatatatatatatatatatatatatgatagaaagaaaaatagagataaataatgagtgttaattttatgtttagcaaaataaaatattcaaaaatgattattctttcttttttgatgtccgttcaatataattgtgatccaaaaacagtaaccaaaacacaataaaataaaatgacccacgaaatgggaataagaaagctagcaacccttggtcgcgcttataattatggtccataccatacatactactactacatagtatttgactatttgccattcgctttacaagtttctattaaagaattatcaaacatgttacttgtcatttaaaaataccaactagagaaatgaaaaaataaatgagaaaagtagtaacataaaaaattgaggaattaacttgatggtagactctttttttaacggatgatagactaaacttttaaaatattaatttaattataaaattattgaagaactaagatagtgacgaagaattcttaagagaatcagtgtatattattagattttccaagcaagctggatttcagcataatagtgcatgtatcctaatactgccttggaagaaaaaagatatcagcatgttttcagtatttggtacagtagatggagacaagtttgttttctgcaaattttcaataggaaatggcatgaaaggataaaagtgaaggtatttttttctaacacttcacaacaaaacaactttcaaagacagtaggaagactccgttctggtctctttatctatgggtcgtcttgcattgcacatataagtttctaattaaaatttgatttaactttcgattttaaatcataaactatataaaacaaagattctaattattttcttttggctgcatcttatctctatgcttcaattcatactcttgtgggttgctatttggaatgctcttgggctgtaatgtattattcactggaaaaccccaatggattgcgcgagagacttgttgaaggtgtgctatatgtcagagtgaaaataaaaacaacagaatccatgcaaattgtcgaggaatgaattagtttaatatggttctgtattatgtgggtttatcactatgtatttatttgccgtaagttgtctgagttgtatcctccaaaggcattgaggaaattaaaattcaggcgttcaaccttcaatccgcacaaaatcagcattttattaggaacaaaatcatacagttttcttgaagaacttacattttcgcaattgaaagtacaagagaatcagtgtatattagattttccaagcaagctggatttcagcataatagttcatgtatcctaatactgccttggaagaaaaaagatatcagcatgttttcactatttggtacagtagatggagacaagtttgttttctgcaaattttcaataggaaatggcatgaaaggataaaagtgaaggtattttttttctaacacttcccgacaaaacaaatttcatagacagtaggaagactccgttctggtctctttatctatgggtcgtcttgcattgcatatataattaagtttctaaattttagaaaaataaattagctctgattcggatatgtccaagacaaaaccggacacaatatacagtgcggacttgatcattttatgactcttgaaatgatccatatccatacaaaagggcatctcaactctcaacccttattactatagcgtcttggtcttggatgtgattgagtggtcattgtttttttaactttcttttgatgagctagttccgtttcaaagttgtgcctacaatgacagtagtatatagaaaatagaaaaaaaaaatgtctttcataaaatttgtcttgctacccaaactctcaaacattagaggtaccatattgaaatttgacatatactattttaataaaaatgatgcgtcttgattcaagtaatttatttatctctttaatttattatttaataaaattgattatttattattaataatgagaattttttttatatataatacaaataatttttttttgcaaccattttttcctctttagtaccatacgtgagtatacaaaattaatgataacaagatataagtaggttagattggccaactcataccccaaagttaaacataatgattgtcctcaaacatttgaaagagtggaaatacttcacacttcaaacaaaattttattaatcactctaatttagattaacatgatctataaaaatctactcaacctcaacaaaagagattaagctaacataaagaaaaatgaagagaaaaaagagaactctataattgtagctaacatcctcattaattaacttgagaatcacagtcagtccttattgtagctaacatcctcatttatgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataatatgcatgttgtggatagcttgaacggttctagcaaaagcactactaaattgggtctcatttttggatatttgtagactagagtttagatatattcaaaatatcacaagatacgtgtttcatccgaagaagactattattaatcaaaaataatataaatggagtaacaaaattatatttagaggaaaccataattaatttaaacattgtcacgataatcaattagtagcaaaattataaatgtttagactttttaattgttggcaatataaaaatattatctaagtaacaaaattaatttgataatgatttacaaatatattattatattacaggcgaaggaagaaaaagcaaagaaagagttgaatcgaaatgaaaggctttgaagcagcgtaggctataaatagaagtttgtgaattgaattggttgtatccaaaaatcgtctctagttttgttgttgagttgaaaggatgaatatgaataacaatgtttggtggcttctactcctatactctatcctccttcttctttttcttccttcttcttcttcatctttctgcaaccaccatgacagctctgccttgctacaactcaaatactcactcaacacttcaaatgacacttcaaatgattttccttccaaagggaccaaaacagaatcttggaaaaacggcacagattgttgtgagtgggatggggtcacttgcgacatcatctcaggccacgtgattggtcttgaccttagcttctgtaatcttgaaggtcaactccatcccaacagcaccatcttcagcctaagacaccttcaacgtctcaacctagcctttaatcatttttatggctcttcaatatattctggaattggtgatctcgtgaatctcatgcatctaaatttgtcatactctggattcactggtcacattccctccacaatttctcacttgtccaaattagtgtcacttgatctaggtagcctctactttataattcttgatcccaactacccgagaatgagaattgatccatacacttggaagaaactcattcaaaacgcaaccaatttaagagagcttaatttaggtcgcgtggacatgtcttgtatcggagagagctctttgtcattgctaaccaatctctcttcctctttgatctcccttagtctccaagacaccaaattgcaagggaatctatcgagtgacatcctctgtgttagaaatatgtttagaagtcccacatcatctatatctctttgtatatgtcctttagtttattatataataggtccaatgttgtgtagttaaaacacaacaaagattacaataaattccttttgtatctcttgatatttaacatggtatctagagcctaacaagaggaacgtaatcaatttctttttccgatgaactcaatgttcttcggattttcattttctttctttttctttccgcacaaggttttcttagtatgctctgtgattgcagcttagactgatctatcacatcagaaaagaattatccttaatcggaacctccgttagccactattctgttccatcaccggcgagcactattccggcgacactattccggtgacactattccggcagcactattccagacacactattccgacggacacacaaaagctgccgcacacgctccctggtccggttagtttattttttctgatttttattctctaagtgagtatggattccccaacctcttccatttctggaacttcggctactcctaagtcagagaatactattttttcaaactatatccttgctccgctgagtgtagaaaaattagatgggtcaaactatgattcttggtcgtcagatctacgcctttggttggatggacaagattacacatctcatctcactactaaggcagattctattacagcaaatgaacgtacaaaatggaagatgattgatgcccaattgtgcagtctcataaaagctactctccatccatcaatcaagcagatttttagacctgcaaattcctgtgaagcagtttggagtcaggcaaaggcattgtacaccaatgatacacaacgactctataatgtgtgtcagaatttaatgactacctttgcccctcgggatttcacttgtcccatgtcggaatatttgggacgagctcagagtttactccatgatcttaatgaacttttacctcctactggagatgctaccagggagcgagaacagcgtaatactctttttatgttgttcattttatatggtttaccttctcatttttcagccaatcgagatcaaattttggggtctgctacagttccgacattggattctgtgatgtctactttgcttagaattccatctaagccttctctatcatcagcatccactttgagccatgtacctctgattgacaccggtgattcctctgcccttgctactcaaggttatggacgcggacgtggacgcggacgtggacgtggaaagtctttttgcactcattgtcaacagaccaatcatactattgaccgttgttggaagctccatggcaaaccacctccgcctcctagaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaactcaacctccaactactcttcttaatgaatttatgacttggtggtctgaaaaacaaggatctggtcccactacttctattgctccttctggtaattcttttgctgctgtctctcaatcacaatctttaggccattggactcttgattctggggcttcagatcacatttctggtaataagtctttattcagttctctttgtaccaatggtttatttccttctattactatggctaatgggtctatggtccaatcccgtggaattggcacagttcatctttcaccccacttatctctggatcatgtactctatgttccagattctccttttaacttactttccattagtcgcttgacaaaatccattgattgtgttgtttcctttactaaaaatgctgtcatttttcaggaccggagttcggggaaggagattaccaaaggacgtgagtctcatggtctctatcagttgttttcttctgcttcagcctgctcttctgtggattctcctctcactatccatgctcgtttaggtcatccaagtctaataaagcttcggaaaatggttccacatttatcgtctctctttagtttaaattgtgagtcatgtcagcttgggaaacatagtcgtagttcgttcccaagtcgtcttaatcgacaagctttgtctcctttttctgtggttcattctgatatttggggaccaagtcgtcatccttctactttggggtttaagtattttgttacttttattgatgattattccagatgcacttggttatttctaatgaaaagtcgttctgagttattttctatttttcagttattctataatgaaataaaaaatcaatttgatgttcctatccgtacttttcgtagtgataatgcatctgaatacttatctcatcagtttcaacaatttcttgcatctcatggcattctccatcaaacatcttgccctcatacacctcaacaaaatggagtagccgagcgcaagaatcgccatcttgttgaaactgctcgctctttattaattgatggaaatgttccttacaaattctggggtgataccattctcactgcttgttatctcattaatcggatgccctcatctgttcttagtcaccaggtaccacattctattttgtttccccatcaagttttatatcctttggccccacatgtgtttggttctacctgttttgttcatcatctcggcccaggattggataaactagctcctaagtcccataagtgtatttttctgggttatcctcgatctcagaagggttaccgctgctactctccaaccttaggtcgttattttatctcggttgatgtctctttctttgaatcagttccatttttttgctcttctactactgttgaaaacgatattgttcagtcacctctaccttctgactcttttgagtatcttccaccttcaccaactgatgtttcttctactaatgagcaacaagtttcttctccagaagttcctatggactcacatctgactacatctcctccttcggcttcggtcccacattctgatagtaaccttcccattgctcttcgtaaaggtactcgtgatactcgccctccagcaaggtatgcagttaatagtagttatcatcgtctttctccatcatattatgcatatctttcctccttgtcttctgtctctattcccaaaactacagaagaagcactttcacattctggatggagacaagctatgattgatgaaatgagtgctcttcatcataatggtacatgggatctggtctctcttcctcctggaaaatctgttgttggttgtcgctggatttatgctgtaaaggttggtcctgatggtcacgtggatcgccttaaagctcgcctggtggcaaagggttttactcaggtatttggattggattatggtgacaccttctccccggtggcgaaaatgtcttctgttcgacttttcattgccatggctgctatacgtcactggcctctttatcaacttgatgttaaaaatgcttttcttcatggtgatcttgcggaggaagtttatatggaacaacctcctggttttgttgttcagggggagtcaggtgtggtttgtcgtctccgcaagtctttatatggtctcaagcaatctccacggacttggtttggcagatttagtagtgttgttcaacaatttggtatgactcgaagtgaggctgatcattctctctttttctgtcattcgacttctgggtctatttacctggtggtatatgtggatgatattgttatcacaggtagtgacagtcatgggattactcagttaaagcaacatttatgtaataagtttcaaaccaaagatcttgggaaacttcgatatttcttgggaattgaagtagcccaatctaaagatggtgttgtaataactcagaggaaatatgctctggatatccttgaagagactgccttattaaattcgaagtccgttgagactcctatggatccaaatgttaagcttatgccaaatcagggggagcctctttcagatcctgaaaaatatagaagattggttggaaaactaaattacctcactgttactcgtcctgacatttcattttcagttagtgtggtgagtcagtttcttaattctccatgttaagaacactggaatgcagttattcgaattcttaagtatatcaaggcatctccaggaaaaggccttgaatataaagataaaggtaatgttaaagttattgcatactctgatgctgattgggctggttgtcctactgatagaagatctacttctggatatgctgtatttataggaggcaacctggtttcttggaaaagtaagaagcaaaatgttgttgctagatctagtgctgaagcggaatatcgatccatggcaactactacatgtgagctcatttgggttaaacaacttctcagagaactcaagtttggggatactggaccagcaactctcatttgtgacaatcaagcagcactacatatctcctccaatccagtgtttcatgaaagaaccaaacatattgagatagattgtcattttgttcgagaaaatgttctttctggtgaaatcataactaattttgtaccatctaatgatcaattggcagatatatttacaaagtctttgaggggtcatcgaatagagtatatatgtaacaagcttggtgcttatgatttatatgctccagcttgagggggagtgttagaaatatgtttagaaatcccacatcatctatatctctttgtatatgtcctttagtttattatataataggtccaatgttgtgtagttaaaacacaacaaagattacaataaattccttttgtatctcttgatatttaacactctgtttacccaatcttcaacatctaggtttggattttaataaagacctcggaggtgaacttccaaagtccaactggagtactccactaagggacttgagtctctctggtactgctttctcgggaaacattcctgattccattggccatttgaagtctcttaacgcactagaattgtgccgatgcaattttgatggactggtccctcatcattgtttaatgtaactcaactctcctttttagatctatcatttaataaattagttggccccataccaagcgaaatcaatagacttcaaaaattgtggtctctagatttgtctgaaaacaagttaaatggaacaattccacgttggtgttattctttgccttccttgttaattttggatcttagcgacaaccacctcacggggtcaattggtgaattctcatcttattctttgatgctcttggcactctctaataacaaactgcaaggtgatttgagtggtcatctggactttcatcaattttcaaagttcaaaaatctatcttacctcaatctttctcacaatagttttctctctattaactttgataataccgctgactacatcttacccaaccttcaacacttatatttatcttcctgtaatattaatactttccctaaattcttagcaccacttcagtatctggtcggactagatctttctcataacaacatttgtggaagcattccccagcggtttcatgagaagctcttgcactcctggaataacattcagcttattgacctcagtttcaacaagttgcaaggagaccttccaatttcacccaatggaattgtgtactttttagtctcaaataatgagctgaccgggaacattccttcagcaatgtgcaatgcaagctccctcaatatactcaacttggctcataacaacttgacaggccccattccacaatgtctgggaacatttccttctcttttggcattggatttgcaaaacaacaacctttacggcaacatacctgggaacttttctaagggaaatgcatttaagactataaagttgaatggcaaccaattggatggaccattaccacgttctttgacccactgcacaaatctgcaagttttggacctggcagacaataacatagaggatacattcccccattggctagaaagcctccaggagttacaggtactcagtttgcgatcaaataagtttcatggtgtcatcacttgtttcggtgcggagcatccatttcccaggctgagaatttttgatgtctcaaataacaattttagtgggcccttaccagcatcatacatcaagaactttcaaggaatgatgagtgtgaatgacagccaaactggtttgaaatatatgggtaacgacaattactataatgattcagtagtggttgtaatgaaaggtcgatccatggagctcgagaggatattaactattttcacaaccatggatttatcaaaaaatatgtttgaaggagaaattccaaaagtacttggagaattgcattctctcaaagggcttaacctttcgcacaatgcaatcactggtaccataccacaatcctttggtaatttaaaaaatttggaatggttggacctctcgtggaaccagttgaaaggagagattcctgtggctttgatcaatttgaattttctggctgtgttgaacctttcactaaaccagtttgagggtatgatacctacaggtggacagtttaacacatttggaaatgattcctatgctggaagtccaatgctatgtggattccctttgtcaaaatcctgcaataaggatgaagatcggccaccacatcaacatttcaccatgaagaatcaggatttggctggaaagctgtagcagtgggctatgcatgtgggttgctatttggaatgcttttgggatataatgttttcatgactgggaaaccacaatggctcgcgagacttgttgaaggtatgcttaattaacgaagaatgaaaaggacaaatcataggggaaggaaatagtttacccttagtttaatatggttcttttgtgtgtgtctgtatgttttctgtaattttacttctgtcctttgtgtaacaaatctcatctctcttgagtgacgtatttcaagttgtttacaaataagaaaaaaatgtgatgatcgtagataccaaaatgagtggtcttcacatgtcatgctattggctcaaaaactttgattctaatctccaaagataaaaacttattagccaatagccaccaattgtatgtcaagcatgccatggtacgagctaagattaaaactggacttttaatttaaaaattggtttcccctacccctattacatactttctccaaacaactatccctaaccaactgagtcaattattgattaaattttgctgcatgatgatcgtagatgcgcccatggcaatgtgtccttttgggaggttccttgagtgaaaataaattaaacaaagtccccataacaatagccttctaataatgctctaaaagctggcacctttgcgaggctttcattaatttgaaagttaaaatggtaaatatttggaccaataaaatgaaacaatattgaccatactagtattcacacagcaaatatgtggcaattgttcttgaaatcaactttattgtctgacagtattcggatcgatgtatttctgggattggtttgtatagggagattttttttatcacaaatattaattattagtattgttaatttttgtgtaggaaagttatagcttgtatacgtgttggatggattttttttatatgtatacataaattgtatttgttaggttatcccatatatcaatattctcttttttttaatgaatattctctcttttttgctgagaaaaaaatagtattcgcgattttattatttagttttgcatttcaaaaatttataagatccaaaaaatgaaagcaaaaaagggtgaagttttaacggtaatccaaccaaattcgcacttacattttaatgtatatgaggatattaactacttaactaccttcacaactattgacttacgtttgtcacttcttctcaagatgaggttttagcagtaattcaaccaaatgtgtacatgcacaagtttagggtgcttgacttaaaaccttcttcaagtgtacctgttatagaaacatatattgaagttgaaatactgctcttcccataatattagctaaaagattctgattctcagctctaaagttaaaaatttagaagcaggagcttataacaagcaaggtataggtctggaattttatgaactcacgacgaaatattaaataaaattcttttgtatttaagtatttaaaaatagacatatatataatatcataacaaatgtacattttatttcactaaataaataatataattttaataaatcttaaaaaaaatatcatattttttatttaagttgctcttatattattatctattattcaatttctatctcttaaaaaatttgcatacacataaatttttatatataaggtagacatgacaaataatggacaaatggagagacatgtttaactatctttatccaagttctttatgaaaatattaattttaattttttttattttataattttaatttttttgtgtttctttcaatatgttgatatatcaatgaattaaaaattcaatcaatatgaagttatgattgtaaaatgttagaaaaattaattaaaagagtgacactttttaataatattaacatattttaatttaaataaaaattgaagcgtaaaataaacaacaactttaatttatttatatgaatcttttaagggtgacgatgtacattgtgatgtaatgagcgaaaactgggaggagcaagagcctgtacttgtacaaacaaagcgccagtcccggaaaaacattccattgcctagcaaacatagcggttcattatcatcttgaatggatcttctcatgagcattaatgaccacaggtattggagttttgaggtaaatgaacaaattagtgaatttgaatttgatgaaaatcacatgtataatgcacagcataaaactagagcattagatagtttgaatttcactattggtggcactgctgtatgatacccgaactctactctcttttttctgtatataaatcaaaatctagagaatttttaaatgaagtatataacagaaatattcaggtcatattttgacagtctgatgcgtgaaacaagttttctagcatagtgcagtttgagatctgatggttgataatgttttaactaaaaaaaattacttttaaaaactccctctcttttcataagttgagataattttataagttgttttttttaaggaaaaaaaaatccttcccttttttttgtttaccaaagtggatggattaaaaaactgtggaccacgtgtttttgcagtcactttccgttatatcaaacagagcttaaaaataatctatttaatgaatattcactctgttttctggaaaaaaaattataatattctaatcttattattcagttttgcattttaaaaatttataagatccaaatttgcacttacattttaatgaaagaggatatcaatacatgtgataacccaacaaatacaatctacgtataaattaagtgattaactaactgagaattttattactcgatctcctaataacaaatgagggagaagctgatcgtttcattccgagaagatatgaaaatgagtgtcatcccatattattggctcaaagacttcgattcttatctccaaagataaaatcttatgagtcagcacttgtatacagaccacagacgttatacatatgacgggtcaagcatgccatagtgattgtaacttataagagcagtcattaaaactggaaactggacttctattttaaaaattggtttctcctagccatattacatgctttctccaaacaactatccctatcaaagtcagaccaattcttgattaattttgctgcatggtgatcgtagatgcgcccaagccaatgtgtcaccataacatcaaagtcaccataacaatggcctggtaattttctaagggctgccacgtttcatatttgaaagttgaaacgatattgatagatatttggaacaaaaaaagaaacaatattgatcatactaatatgcacacagcaatgaattgatcttgaaattaaaaacatagtcctacttctgaaatttatacaccctagcaatgtccaaatattgaaaacaaatttattcactgatactatattcagatcctattattcagttttgcattttaaaaaatattggaaacctattaaaaatttatatcaaaagataaaacaaataaaaagcaataatagcaatatactcttgtgtaacatttttattattatgggctaaatttgatgtcaattctattataaaatttgagtgatggaatttacataaaacccactcaatgattaaagatttatcaaaaggactttctagcatttcacaactgccaaagagtttacagactccattttggcatctcaaatccatttgttaaacgtaatttttcctttaataaaatggctcacgtgaaacgtgagtcacactctctccactttaattgaacattctcatcatctatattctggacgtgaatttcaaacattatttctgtaaattaaaacgtctcaaactctcattttgctttatctgtatttgtnnnnnnnnnnaatttattcactgatactatattcagatcctattattcagttttgcattttaaaaaatattggaaacctattaaaaatttatatcaaaagataaaacaaataaaaagcaatatactcttgtgtaagatttttattattattggctaaatttgatgtgaattctagtataaaatttgagtgatgggatttacataaaattcactcagtgattaaagatttatcaaaaggactttctaggactttctagcatttcacaactgccaaagagtttacagactccattttagcgtctcaaatccatttgttaaacgtaatttttcctttaaaaaaaatggctcacgtgaaacgtgagtcacactctctccactttaattgaacattcttatcatctatattttggacgtgaatttcaaacattatttctgtaaattaaaacgtctcaaactctcatttttctttatctgtatttgtatgtttaaacattttatcactattttaaaattgaattttaatagttcttataaaaacagattatcaatagttaaacatatcatatcataatttaaattattcattataaatttaaaatataatttatatattaaaaaaattactgaaacaatttttataagctgaatttcaacaatatttatttatgatgattttaatgatataaaaataaatttaatatgattctttcgcgtgcgatgcgtgttgttttatgtaattttaacttttgcctttttggaagaaatctcatctatcctgagtgatatatttcaagtgttttgcaaataaaaagaaaaaaatgtgatgaatacttttgttttaatttcaagtaactaattttccgtaaattatctagggaaacgtgtataaggatcaaggaacatttgtacattgaactttcaatcgacccactattggcattatattaggaacatatatttactgttttctggaagaatttaggctaacacaattaaatgtacaattgtatcattgtattttcagatgtagttagttcatgatgaatgttgttcaggcatcaaagctactgagaaaagtagaaaaagaaaattgaaaattgaaagtaacataagaataaaaataatttaatttttaatacaaggtaattagctccttaaggttactttctagcatcattccaaagtcttccttttcttttggctgcatcttagctctctgcttcatactcttgtgggttgctatttggaatggtcttatgatatggaatccaactcaccaagactcccaccattatcataaggttcccaccatcatacctttcaccaccaactcacatccataattcaagttttcttttctttatttaattgtaccactttctttatttaattctagaattactactataaataggagtatcatcaagcattgtaacacacaacaattcatttgaatacaagaacaacaagttcttctcttttctctctagtccttttagttcctgagccatcttgggctgtaatgtattattcactggaaaaccctaatggattgcgagacttgttgaaggtgtgctatatgtcagagtgaattgaaaaaaacaaacaacagaatccatgcaaattttcaaggaatgaattagtttaatatggttctgtattatgtgggtttatcactatatatatgtatttatttaccgtaagttgtctgagttgtatcctgcaaaggcattgaggaaagtaaaattcacgcgttcaagcttcaatccgcacagaatcagcatttgtttaagaacaaaatcatacagttttcttgaagaacttatattttcgcaattgaaagtacaagagaatcagtgtattttagattttccaagcaagctggatttcttgaagaactgatcagcataatactgtgttctgctcggtgagaacagaaatgtccaacaatggtgttggaggatttaatgtaggatcaaactctctctctctcaagaagcttatgaatacgaaaccacttgaggaagaagatcaccgcacaaggaacacgacacgttgagggggtgcagtgtgtgcaggtgtgaaggaaaagagagagctagaaaatgtgtaccgttcaccatgactgaagaagtatttataccagggtgcccatgaggcggttgaagctcgtgatcttatgccatgcggttaagcttgaaaccgttctccttgatatgcggagatatgggttcgtgggagataacaaacttatcccacctttcggggtggttactgtgggccactatcagtcgtttgactgctttaaagggggagataacaaactcccgtaacagatgcccctcagcccggtcttctagcattctggatggccgggatgtatcaataatgctgccgactatgctttttaggtactacccacgcagggccgagttcgaaatccgaaccgacgtgaccatcatccgaaccgacatgctcaccacccgagccgaggaagttgagatccgagccgaggtcatctctatttgtattgaggcgatcgaggtcgttccgaggtgacccctgtccgagccgttttatctttacttagccgaggcacacactatccgagccgacacgatcaaggccgagccgacataaccatgatcaatattgtcgtatagtatcgatgccccttgtcgggatatcatatcttctgtcaattcatcaatcacttcaatatcgtcgccgagctactccttgtcttttcaatgcagcctctgccgctactgacctaggggaatggaacgtctccaacttccttatcgccacgtgtcttagtaactgctgattttcaatcatgacttttggggctaaaagacaatcttgcccctatacccagcagttatcacttatgatttcaaattctggcggttactttttcatttaatgcgccttttccgttttcatcgtattaaacctgacttcaattctcattcctctctgtctcttatacttttgcattttctccttactgtgcttcttcgtttcttcttcctggctttcgtctccttcatcgctgttgcctttcccattgcttcactgagttgctcgtgtctgatcatcaacccttctttcttcctcctttccaggtattccgcgcgtctctttaatctgccactttactgtttcgtatttcatcattagcatttcttaatctttgcatttcctttctctgcctttcatcctcttttcttcctttttcttggccttaagcatgaagtatactcctgagcaagaagaggaaatctggaaaacggtttctcctcgtactgctttttggctttttggattgcccctttctgaggaggaaaaaagaaagtctctgcttagggctccctctgccccaggaaattccagggtttcccttcctagaccccttaacccttccagattagggccttctaggttagggccttctaggttagggccttctagtttaggatcatcatcccgacaaagacccgcgctccttgctttgcaatctaaggcctctcctagggtttcccctcctccagatactgctgctctgggtgaatccgaagcctacccgatacccgaaacggattcagtgattcggtatgaacactgtccacgttgtatagaggagtttatatatctcgccagcatagaccacgataggcaagccgagggagtgttagaccgatgccgacataaccctgtttgggttcgtaagtctgttccaaaagaaacaaatattcctccgacccaaccgagccgtgataccgggatgccgacctctgttgaacaaccgatttctgctgaagaccctaaccggccaattccgacctcttcttctcttcgtcctttgacgaccctttcaggtacttcactaataattcttttttgttatcgtaggtgattatggactcatctcgggccagaagtgttgatgaatccgcaactgggtctcggcctcaagttccttctcccgcgctaacaggtaggtttccttgggtaacccatgaggtgctacaacacacctctactatggattccgaggaccttgcttcaattcctttggaggttcaagaaggtttccacgtctgtcttccccgcccgggtgaaccaatttgttcttcccgagaggggaatgaccccgacttctttctgttttataaagatgtcgtcactcggttgggagtttattttccctttaccgacttccagatgcaggtattgagtcatctgcaagttgctccttcccagattcatccgaacggctgggcttttatgcaagccttcgagattctctgtcaaaaactggaacttgtatgtacccgtcctttgttcttttatttctttatggttcaaacaaaccgatccggtaaggaacctgccgaccgaaaaggttggacttcttttccggggtcgcactgatcatcgttctgatcgtcggcttttttctctatacgctgagtcctttaagggcttcaaagataaattttttaaagttgtggccgaacctggtcaatgtcccttttttgctctccctcctgggtcttcctcggaatcctggaagtttcccctgtattggtcttccgtccatcatgaccttccttcagcctcttatcgaaccgacgaggctcagttgtcggattctgacgccacgtctgctgcccgaataatttcatacaaagagtcgggaaacttggcccctatatcttactatgttcggtgtggtcagtcttaatgccttttgaaaataaatcttgaatgattggcttttttcttgatgtctaatactttgatgtttatgcagctgtcgaaatgaaccccggccgtcctcctcgacccccccacctagaagccttaaaatctcggaagaggcgaaggttggccgaggggaagagtaaggccacacccggtggctctgaagtcgccccggtttcgaccgaggttgccgccgaggcccctgcatctcctctcccttctgcttcggtggccgaaacctccgtcgtcattttggatgggccgtcggacgacgctcccttggatgctccggttttggaggatgctgttccttcctcggagtgcgagccgaccgaggatcctcagcagctgtctccccggtctctatggacccatggtgtgaccgcagacctcttggcggcggtgcgggcccctaggaaatattctgacatggttcctctttcaactcccgagttagaagaactcggtttgttggaggtgtcatgtatgaagaccgccaccttgctaagaagcttggccgcgctgaagaaaaagtccgccaagatgtctgctgaattcgaggcctccaaggtcgagaatcaacggcttcaacaagagctggatcatgctctcaaagaggtggacacatctcgggcggaggccgcagaggcgcagggggcggtggtcaggctgaccgccgatcttgaggagtcccgagcagctcttgaggcttctcgggtggagaccgactctgctcgtgccgccgttgcaaagctggagcaggatctcgtggctaaccgggggagagctcgggaggctcgcgatcgttgcgatcagctgctcgcccttaatgagaagaagtccctggagcattccgagatgctgagtgaactcttgttcgttagggctcaattatcgaaatctaccgaagcttcttttaacaatgctttggatcagattcgctttttgaaccccggcattgagttgaacacctcgggtatgcacttcaaatcttatgtcgggaacggtcagctgttcaccgcttccgacagcgaggatgaagaggcgagtacggatgcacccgaggagaccgggactccagttgacggcgggaactgaagggccgggatgccggtttcattttgtatattttgaacagttccttttcctgtatttgaacaagtatttttgcactttttaaagtacatttcgtcggcttttataacttgctgtttatttctaccgtatattggctccaacggccaacttgctagtcggttattatcgtcggtttagccatattttatttaacccgaattattcaatcggtattaaaaatagaatagggatcatgttcccgtcttagcaactgttaatatattcataactttatcctttagatgtaattctttcggaaaaatccgatgattcaccctggattgaatagttacgccggcctgatcaagaccgagttaatataaaacaacgactaagcgctcataattcgtgcacgaagaatgttccttgcattaaggattttattaatagttcatgatatcaattacatctttgcgcgggtgtatgttcccggttcacaattgattgatacaaacatgaaagaaatttcaacttgacctcaaaatagatttgcgcgggtgtatgttcccggttcacaaaatctaatgaaagtcactaatgccatgatcccaatgacgggcccgagggccaactaaagggaaacacatggtgtccatgattccgatgacggacttaaggtcggctaaagggaaacacatgatggagtttcatgatcccgatgaccgactagaagccaactaaaggaaaacacatggaccttgtccgcttcttgtcaactatagtacttctttagcttgtctgcgttccaagttcgttggacttgcttgccgttcaatgtttccaacaagtaggctcctcggccaagattttgggttactcggtacggtccttcccaatttgccgctagcttcccgtctcgagcatttttgttcccgatatctgctcggcgtaacacgaggtcgtccttttcaaaggacctcggcttcacttgcctattaaatctttgcgccagcttgcttttttgatggaggtcctgacggtgggcggcagcgcggacttcttctatcaagtcaagctcggcggttaaggcagcattgttgtcactctcttgtgatatatgccgccttctccatgatgattggccgatttctacaggaatcatggcttcacagccataggtcatcctgaatggggtttcgccagtagctgtttgggtcgtcgttctgtaggcccaaagtacgtagtacagttgctcgacccaattcgggccggcttcatgcattcttttcttcaatccatcaaggatgactttattggccgcttctgcttggccgttggactggggatgttctactgaagcaaaatgatgtttgatatggaggccggtcatcgttgcttggaatgttctgtcggtaaactgcgttccattgtcggtaatgatttccgccggaatcccgaaccttgctattatagcccgctccatgaacttttgaacccgagctgaggtgatggnnnnnnnnnnccactattagccatcgcatttgaccctcagtagctttgaacggtcccagcaaatccataccccatttgtaaaacggccatggtgcagtgatcaaactaagctcggacggaggggtccatactatctttgcatgtttttggcaagcgtcgcaccttttaacgtgttccgttgcgtcggctttcatcgtcggccagaaatagcctgcacggagagcttttagtgccaaagccttagcgcccatgtgttgtccgttaatcccttcgtgtatttccgaaagcacatactcggcttgatccgagttcagacatagtaatagtgggctatgtagacctcggcggtataattcatcgtcgaggattacatacctcgccgcttctcggattaacttttttgcctctagctcctcgtccggggtgattccttgctccaaatagttgacgatgggtcttctccagtcgttcgcgataaatatgatcatgacgcatgctggtcgggcgagttcctgttggataactgatctatagtttcccgccccttttgtgctagccaactttgagaggatgtcggctcgggtattttcctccctcgggatgtgggcaactatcacttcgtcaaattccgccataatttccttcacttttgccaaatatttggctagcaagggacctttagtctgatatctgccttcgatctgcgcggaaaccagctgcgagtcggtgaagacgttgacccttgttgctccttgctccttaacctgcttcaaacctgcaatcaaggcttcgtattccgcttggttgttagaggtcggaaaattgagctgaagggactgttcgagggataccccgtcggggttttcgacaatgaccccggcaccgcttccttttgtgttggatgagccgtctacgtatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcctatcttggtggtttggaatgaggagtcgccgatctggatgtcttcaagctcgtccgccggctcgggtctccattcctctacatctcgcatatcaagttctactaaattgatcggtttccgaggaggctgttcctcggtttttgatcctctttgctctcctggccgtactcgatgtggtgatgaagggccgccctccgtttctctgatcgtgttgtaataacactgccgggactctttctgatctccgcaaatcgtaatgactttgccaaggtgtcctaccatcttcattttctgatgctttgtggacatcaggatatcccacttatgaagcgtgggtctccccaggataatgttgtatggtgacgggaattctccgacggtaaacgtcaccttttccgacttgaaaccttctctcgttcccaacgtcagctggaggtcgatcaccccctttaggccggtaccttcgccgttaaagccatacagcatcgtttggcacggcctcaggtcttcctccttcaagttaagcttcttgaaggcgctccagttgataatgtctgctgaactgccgttgtcaacaaatatccgcttaacccggaagttagcaactgtcccagttatgacgagaccgtcttcatgtccgggcacaactcccttcaagtcttcatcggtaaaatagatcaatggaggtgtgtctttcttgttgcctccgccgtcggtttgtttgaactttggccggtctcttaccgacataacttccttgagatatttcttccgctgatttgccgtatcgcctcctcctcctaatcctcctgcaatgacgttgcattcgaattcaggttctgggaattcgtcgtcctttttgctcttcttgtcgtctcgtggcttattctcctgttgggattttctcttggcttggtgcccctgggttcggattacatactggcgtaacttgccttcgcgcacgaatttttctatggcgtctcggagttcccaacattggtcggtcgtgtgtcccggtccattgtgaaagtcacaataccgagtatagtccatcccttcctttcgtatcactggaggaggccgattgacctttctcatttccgtgaaggccacttctttccaaatctgtccccggctggcgcttaatggggtatacctttcgaactttgattcatacttccctggtctaggacgattgtcgggaaatcctcgcggcggtcggcctaccgctgcattagtgggatgccgactggattgcccgacgtggaaggtatctggtcgtcggttccgtggcggcgacgatttcttattttcttttgaagccgagttggctatttccatctgctctaactccagatacttttgagaccgaatgccgaactcactcagggatttaacgggatctttgtagattgatttggcaagtcgggaagacccgttaagccccgccgacaagagataaacgtgaacgttctcttccaggccgtgaacctgcaatgccgcctctctgaatcggtctaggtaactttgcagtgtctccccgtgctgttggcgtatctttcccaacacgaactcggatttgggctgcttcttgcttgttgcgaaatttagcaagaatttctgtccaaaatcttcgaaattgcggatggtcctcggtggcagtgagtggaaccaagtctgggcggctcccgtcaaggtcgtcgcgaagattcgagatatgatcggctcgtcgattcctcgcacacacatctgcatatcgaactcatcgatgtgcatctgtgggtcttgacttccgttgtacttattcaagaaagacccatcaaagtcttccaagaacggggcgttgactatatggtcaacgaacgggctattattctggtgaccccggctatacttcctcctatacgcaccatttccttcaccgagacgacgggctatctcccccgtcggtctttcctccgcggtatgtgaaatggccatcgatgattttcctcgttcaggttggttgacggggtctctttggttggtcccggctgctcgggccgacactgatggtcccgacctccttgccgttgcatggtcggcttctgtgcggtcttcgtcacgtctatcgtcggtattttgccgacgtccctcctcacgtcttctgtcgtcgcgatcctccaactgagcgatcagctgtcggatgtcttcctggcgttgcaattcataacgcttttccagattctccattctagccaacagggattggagagcgctctggatgaaacgttgagaacttccttgctcggccggtggtgtgtcggccggcacctgcgttgttggctccacacgagatgatgctgtgtgggacaacgcgtcttctgctaccacctcctccggagtcggattcctgggtgggtcttcacgtcgggcgttctggtttctcctagcgttagccattgagagatggtgggagtcgaattttatcgttcccacagacggcgccactgttctgctcggtgagaacagaaatgtccaacaatggtgttggaggatttaatgtaggatcaaactctctctctctcaagaagcttatgaatacgaaaccacttgaggaagaagatcaccgcacaaggaacacgacacgttgagggggtgcagtgtgtgcaggtgtgaaggaaaagagagagctagaaaatgtgtaccgttcaccatgactgaagaagtatttataccagggtgcccatgaggcggttgaagctcgtgatcttatgccatgcggttaagcttgaaaccgttctccttgatatgcggagatatgggttcgtgggagataacaaacttatcccacctttcggggtggttactgtgggccactatcagtcgtttggctgctttaaagggggagataacaaactcccgtaacatactgtatcctaatactgccttggaagaaacaagatatcagcatgttttgactatttggtacagtaggatggagacaagtttgttttctgcaaattttcaatagaaaatggcatgaaaggataaaagtgaaggtgtttttttctaacacttcccgacaaaacaactttcaaagacagtaggaagactccgttctggtctctttatctatgggtcgtcttgcattgcatatataagtttctaattaaaatttgatttaactttcgattttaaatcataaactatataaaacaaagatgtttttttataaaatatatttaaaaataattgtaatctttgtttatctcaattaaattttgaaatttgacatatactattttaataaaaatgacgtgtcttgattcaagtaatttatttatctctttaatttattatttaataaaattgattattcattattaataatgagaaaatgaataatttttatttatatataatacaaatttgttttttttcaatcattttttcctttgtagtatcatacatgagtatacaaaattaatgataacaatgatataagcatacaaaattaatgatatataacaatgatataagtaggttagatggaccaactcataccccaaagttaaacaaaatgattgtcgtcaaacatttgaaagaatggaaatccttcacactttaaacaaaattttattaatcactctaatttagattaacatgatctatagaaatctactcaacctcaacaaaagagactaaactaacataaagaaaattgaagagaaaaaagagaactgtataaatccttaaagagacatggcttactacattcagactcaaactcacactaattaacttgagaattcagtccttaattacagctaacattctcatttatgatattaagggaccaccatcaaagaattgcatttagcatgaccacaaggttctcattcattatccttgagttggtgtagaatattttgtcattccttttaggaagtttcttggcatcttgatcaagggagactcgacaatagctagacatagtttttgtcatttgttttagaaaacttcttgtatattcaccttatagaagacaatctaaatagttgtcaaacataataattatcatttttataggaaattgtaagtgtcttaactcttaatgaaagaaacattcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatataattaatatcgttttatttttattgattaataataactatcttttaaatacttaccttaattataatatatttgtttcagccaaattagtaaaataatattttgcaactaaattttggcaatagctatataaatttaatttaatttgtattttatgtattagttttattttgatttagcaactaatttttaaaaaagtttaaatatatttttagtctttataatttaaagcttttatgcttttagtttttgtaaaattatttgtatttccaatcctttcaatttatatttgttttattttttgtgttcgtaacattttagataattttttttacagtttaaaaaactattttatgtattttaaagattaaaaataaaaaaatttaatttataaatattaaaattaaaataatagttttgtaaggacgaaaaggaaaaacaataaattacaatgacaaaaaatataattaaacaaaaaaactaaattaatacatgcataatttagaagaaataaaattaaaaaaattataaatgtttagactttttaattgctggcaatataaataaattatctaagaaacaaaattattttgatatgaaacacgggcgaaggaagaaaaagcaaagaaagagttgaattgaaatgaaagcctttgaggcagcgtaggctataaatagaagtttgtgaattgaaatggttgtatcaaaatcctctataattatgttgttgagttgaaacgatgaatatgaataacaatgtttggtggcttcgactcgcatactttctcttccttcttcttctttttcttccttcttcttcctctttctgcaaccaccatgacagctctgccttgctacttttcaaaaactcgcttgctctcaacactacacatgattatttctttttctgcaacccccttgacacctctgccttgccacaactcggaaactcactcaacacttcaaatgattttccttccaaaacagaatcttggaaaaacggcacagattgttgtgagtgggatggggtcacgtgcgacatcatctcaggccacgtgattggtcttgaccttagctgcagtaatattcaaggtcaactccatcccaacagcaccatcttcagcctaagacaccttcaacgactcaacctagcctttaatcagttttctggctcttcaatatattctgaatttggtgatctggtgaatctcatgcatctaaatttgtcatactctggattcactgctcacattccctccacaatctctcacttgtccaaattactgtcacttgatctcggtagcctctactttataattcttgatcccaactacccgagaatgagacttgatccatacacttggagcaaactcattcaaaacgcaactaatttaagagagcttaatttagatggcgtggacatgtcttgtatcggagagagctctttgtcattgctaaccaatctctcttcctctttcatctcccttagtctctctgacaccaaattgcaagggaatctgtccagtgacatcctctgtttacccaatcttcaaaaactatctttgttttataataaagacctcggaggtgaacttccaaaatccaactggagtactccactaaggtacttggatctctctgagactgctttctctggaaacattcccgattccattggccatttgaagtctcttgacacactacagctgtggggttgcaattttgatggactgcttccctcatcattgtttattctaactcaactcgtctatttagatttaagcgataataaattagagggaccaattccatccgaaatcaataaactttcaaaattgcagtatctatttttgtctgataacaagttaaatggaacaattccacgttggtgttattctttgccttccttgttagagttggatcttaacgacaaccacctcacggggtcaattggtgaattctcatcttattctttggaagacttgtcactctctaataacaaactgcaaggtaatttgagtggtcatctggactttcatcatttttcaaagttaaaaaaactatctagcctcgatctttctcacaatagttttctctctattaactttgatagtaccgctgactacatcttacccaaccttaaattcttatatttatcttcctgtaatattaatactttccctaaattcttagcaccacttcaaaatctggcccaactagatctttctcataacaacattcgtggaagcattccccagtggtttcatgagaagctcttgcactcctggaataacattagtcatattgacctcagtttcaacaagttgcaaggagatcttccaattccacccaatggcattcaatactttttagtctcaaataatgagctgaccgggaacattccttcagcaatgtgcaatgcaagctccctcaatatactcaacttggctcataacaacttgacaggccccattccacaatgtctgggaacatttccttttctttgggcattggatttgcaaaagaacaacctttacggcaacatacctgggaacttttctaacgtaaatgcattggagactataaagttgaatggcaaccaattggatggaccattaccacggtctttggcccactacacaaagctggaagttttggacctggcagacaataacatagaggatacatttccccattggctagaaagcctccagcagttacaggtactcagtttgcgatcaaataagtttcatggtgtcatcacttgtttcggtgccaagcatccatttcccaggctgagaatttttgatgtctcaaataacaattttagtgggcccttgccagcatcatacatcaagaactttcaaggaatggtgagtgtgaatgacacccaaactggtttgaaatatatgcgtaacgactattcctataatgattcagtagtggttgtaatgaaaggtcgatacatggagttcgagaggatattaactattttcacaaccatggatttatcaaaaaatatgtttgaaggagaaattccgaaaatcattggagaattgcattatctcaaagggcttaacgtttcgcacaatgcaatcactggtaccataccacaatcctttggtaatttaagaaatttggaatggttggacctctcgtggaaccagttgaaaggagagattcctatggctttgatcaatttgaattttctggctgtgttgaacctttcacaaaaccagtttgagggtatgatacctacaggtggacagtttaacacatttggaaatgattcctatgctggaaatccaatgctatgtggattccctttgtcaaaatcctgcaataaggatgaagattggccaccacgttcgacatttcaccatgaagaatcaggattttgctggaaagctgtagcagtgggatatgcatgtggattgctatttggaatgcttttggaatataatgttttcatgactgggaaaccacaatggctcgcgagacttgttgaaggtatgcttaattaatgaagagtgaaaaggacaaatcataggggaaggaaatagtttacccttattttaataaggttcttttgtgtgtgtcaatatgttttctgtaattttaacttctgtcctttgtgtaacaaatctcatctctcttgagtgatgtatttcaagttctttacaaataagaaaaaaatgtgatgatcgtagataccaaaatgagtggtcttcacatgtcatgttattggctcaaaaactgattctaatctccaaagataaaaacttattagccaatagccaccacttgtatgtcaagcatgcgatggtacgagctaagattaaaactggacttttaatttaaaaattggtttcccctacccctattacatactttcttcaaacaactatccctaaccaactcagtccaattattgattaaattttgctgcatgatgatcgtagatgcgcccatggccatgccaatgtgtccttttgggagtttccttgagtgaaaataaattaaacaaagtccccataacaatagccttctaatgctatgaaagctggcacctttgggaggctttcattaatttgaaagttaaaacgatattggtaaatatttggactaataaaatgaaacaatattgatcatactagtattcacacagcaaatatgtggcaattgttcttgaaatcaactttatagcctgacacaattcggatccatgtatttctgggattggtttgtatagggtggtttttttttatcgatatatattatttgttagtattgttaatttttgcgtagaaaagttatagcttgtttacttgttggatgaattgtttttatatgtatacataaattgtgtattgctaggaaaaaaaatagtattagaatcctattatttagttttgcatttcaaaaatttataagatccaaaaaatgaaagcaaaaaagggtgaagttttgacggtaatccaaccaaatttgcacttacatttttaatgtatatgagaatattaactacttaactaccttcacaactattgacttatgtttgtcacttcttctcaggatgaagttttaacagtaactcatgaattactgttaaaaccaaatgtgtacacaagtttagggtgcttgacttaaaaccttcttcaagtgtacctgttatagaaacatatatgaagttgacatactgctcttcccataatattagctaaaagattttgattctcagctctaaagttaaaaatttagaagcaggagcttataacaagcacggtaggtcctgagattttatgacaaaatagatatataatatcataacaaatatacattttatttcactaaataaataacataattttaataaatcttaaaaaatatcatattttttatttaagatactcttatattattatcaattatgcaatttctatctctaaaaaattttaaatacacataaatatttatatataaggtatacatgacaaataagggacaagatggagagacatgtttaactctctttatccgcgtccctaaaaaggtaagaatgatttaaaagaaatcatattatgttttttaatccaattcattttaaattttatcgaggttggataaactcacatggatatatatttttttaaaatattaattaaatttatgatttaatttatttttttatatttgatccttcaaaaagaaaatgaatatatatatatatacatatatattaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatcttatatattaatttgatatatactatattatatattattttataataatcttctcataaatgaatatatatatatatatacatatatattaatttgatatatactatattatatattattttataataataattgtagtaatataattattaaaataattaatgataaaaaagagtataatagtatatttgacattcttttacttgttaattattcaccaaacaaaacaataagttgtcaagtaacttaaacaatcattttgctttgttctctttgtattataaattaatagtttcaaacggattaataaatgaacatgtacaatagaaactggtgcactttaaaagtatttaatgtcaacgacgtagtggcgaatgcatgagaaaatgttgtacatattaaacttttgtaatttgttgttaataaaatcatttttaacccacaacttaaattaacataaaatacagattcagttaaacgtgaaatataaggaaaattagaaacaatacaatataatattaaaattaatgttgctatggctaagtataaaaattttcacaactttaattagtcatcacggcaggcctgaaattacttatataaatatattcacagccaatccagatccagcgtgatgcataatttcatcccgtgcaattttcatgtaagacggcacaataatgttaaaaaatttaacgtgagtgataagaaatgtttgtattcgtgacaaattttataaaattgtcactctccacaacgggaacaataacggtgatgcttataacttctgcaacaaagttcataaagtgagtaaagtaaaattataacatataggaatcgtactaacttctgaccttaaaagttcaaaatgtgagtgagctaaacttgggatatgtttagcctagcttatttttagcttaacttctacagccaaacactaaaaccataaatatttgtaacagatggtgggagtcacataattgcccccggtctcaagaagctctaggaaataatttgatgcacgcaacttcaactatttttttttctctgtttttttatattcgttattagcataagcttaattataaattcacaaatatttgcattttatttaaaaaaatcataaaaatgtatgagaagtttaagttgaaatatataatttctaagctaggcccaacaaggatggaagtaaaacctgcagaaaccacctggattgctgatctcactaattgtggcctatacagagtactgagagtagcctttcgctattttccctgtttttacaaaagcccatagacgtagcagaatatgccaaattcatcccacgaaagacgagaactcatcaataccagtttcctaattataaatctttactggcttctcgaaagtgtgccgattctgaaacaaaacgcacgcaatttgaaatggtgtaataaacaaagttctctcaacctcaaaactaaaacccagtattaccagaatagtggacaaccacaaaacaattaaaaacaccaaaatgtacttaataaaaattgctcgtgcaggcaaagttacaaacctggttaacagcatatgatcttttaggagcattgtcagtatgctccaagccaagatactgctcccaagcaccataaacatctctcctctatcacaagatacaatgcaagcataaattcagacatgaaaatgatgctaaatatcaattgaattatcacaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaattcaagatatggagaaagaagctaaggtgtacagcttatttttaaaaaatactccagttaggttttttttaagtagttacttttccctccttttcttttatgaaaaatacatttcttaatttttaagagtttttttctaaatgtgtttgacttaacttctctttttaagaagaaaaattaccatctaagtttgttgtcaatttgcataaaaagttaccatctaagttttccttttactaagaagtgtggtatacttattgctgttaatttaattttccagtcagtatgcaattcttcatagttaatgcaaggaaatacacaatctcgcaatatgagttcatatgaaagatgagcaaattaaattattatattatgaatcagactatctgaataaattgttttaactttttcggtaggtggagcatcaagcttcagtttgccccctgcgtctaattacatgccggttttgtggtgatataagtttcaccttaacctaatggagatttagccattttttgcagtttctcgaaactctcacaaactttgtgatcatatatacagtttttcttctaacaacatacaaactttttgcaaattgaaaattatacaaatttctgtggttcaatagatttacaagcagatagtagtatctgttaacctataaaaagacagttaatcagtaaaatagttaacctataaaaagtgttattacataaattataataaccgatgttataaaaacaagaacttagaattaatgcaactttctttaaaaaaaacatagaatgcaatattaataccttttcaataacttaaaaccattaataattaaagaacaaatagctttatataatatataaaaataccaaaatatcctaatttattaatactctatttttatatgtaaaaaaaataaaaataactaagatccaccactgcttgggaaatttaagaaatttggaattgttggacctctcaaggaaccagttgacgagtgagattcctgtgactttgacaaatttgaattttctcgttatcttaaacctttcacaaatgtgtggacagtttaataatagatttggaaatgattcctatgcttgaaatccataatccaatggtatgtggattccctttgtcaaaatcctgcaatgaggaggaagaattactaccacgttcaacacttgatcatgaagaatcaggatttggatggaaatccattgtagtgggatgtaatgtattcttcactggaaaaacccaatggcttgcaagacttgttgaagatgtgctatatgtcagacagtcagagtgaaaagaacaaacaacagaaacaatgcaaactgtcggggagtgaattagtgtgtgtgtgttaatcagtatgtattttttattttgtaattttgtaattttaacttctctgtttgtggaatgaaatctcctcccaatatcattagatgatgtatttcaaattgttgtgcaaataagatatttagagatcaatcgcttttgtttataaattaagttcaatttatttgccacgcacaaattgtccaagacttgacctgcaaagacattgaggaaaattcaggcgttcaaccttcaatcatcacaagatcagcattttattagggacaaacttgtacagctttcttgaaaaacatacattttttacacaattgtgttcagatttttcaaacaagctgaatttgtgttttattgtttactagaagccgtactaattaaggtagcatcgagatggatgaaacaggtcttgagcaatgagcagcatgctagtctcttcttacagagaatgtgcatacaaacataggggctttagttgaaaccttcttgtaccagaaaaaacataccagaaaaattaattttatttttattatattttgtttaacattaaaattattattttcacttttatttagaaataatataaaataatattacaactttttttataacataatagtaattatacataatgatgtttaacattatattttaacaatattaatacatcatttttaatatataaatgaaagtaaaacatatatcttaattatgaaacaaatgaaaattaataaattatttaatatttattattatttatcaataaaaattaatataattgatttgatttagtttttttataataagatttaaatataattaaattataaaaaatataatttttttatatttttattttttgtaatttttatttaaatgattttgatttttttattgatttgacagtttataaatagtttgatttaattttgaatattcctattataaaatggcatcaattaattgaattaaatgataaatgtttggtttttctaacactttcagagaaaaaactttcaaattaagagaatgggaagactccgttttggtctgggtcgtgttgcatgtgttttaattaattttcactttgagaagacaagacatttacgccaacaccaacaacagaataatataatttaaaacaaatgataaaaataaaataatatttatcatcatctgatttgagtggtcatctagactttttcttcttttagaaaagagataatatatatatatatatatatatatatatatatatatatatatatatatgagagatgacataatattatagaaagaaacatataataatttcttgtcgcaacatccccaattttgcttgacagctgattccggattactcactcaactatcctttttagatttattatttaataaattagttggcctaattccaacaaaaatcaataaacttccacaaatgtgagccctactttagaatttagtgaaattccacgttgatggtattctttgccttccttgttacgattggatcttagtgacaaccacttgacggggtcaattcagtaagtttctcatcttattctttgaaatatttctcatcacctgacttgagtggtcatctggacttttctgtttctttttctaagaaagagataatatatgtaatatataattatgataagtaacatgatagaaagaaaaatagagataaataatgagtgttaattttgtgtttagcaaaataaaatattcaaaaatgattattaatattctttcttttttgatgtccgttcaatataattgtgatacaaaaacagtaagcaaaacacaataaaataaattgacccacgaaatgggaataagaaagcgagcaacccctggtcacgtacgcttataattatggttcatacatactactacaacatagtatttgactatttgtcattcgctttacaagtttctattaaagaattatcaaacatgttacttgtcattaaaaaatacgaaccagacaaataaaaaaataaatgataaaagtagtaacataaaaaattgaggaattaacttgatgagagacttttttttattacggatgataaactaaacttttaaaagattaatttaattttaaaattattggagaactaagatagtaactgttacgggataagtttgttatctccccctttaaagcagtcaaacgactgatagtggcccacagtaaccaccccgaaaggtgggataagtttgttatctcccacgaacccatatctccgcatatcaaggagaacggtttcaagcttaaccgcatggcataagatcgcgagcttcaaccgcctcatgggcaccctggtataaatacttcttcagtcatggtgaacggtacacattttctagctctctcttttccttcacacctgcacacactgcacccactcaacgtgtcgtgttccttgtgcggtgatcttcttcctcaagtggcttcgtattcataagcttcttgagagagagagagagtttgatcctacattaaatcctccaacaccattgttggacatttctgttctcaccgagcagaacagtggcgccgtctgtgggaacgataaaattcgactcccaccatctctcaatggctaacgctaggagaaaccagaatgcccgacgtgaagacccacccaggaatccgactccggaggaggtggtagcagaagacgcgttgtcccacacagcatcatctcgtgcggagccaacaacgcaggtgccggccgacacaccaccggccgagcaaggaagttctcaacgtttcatccagagcgctctccaatccctgttggctagaatggagaatctggaaaagcgttatgaattgcaacgccaggaagacatccgacagctgatcgctcagttggaggatcgcgacgacagaagacgtgaggagggacgtcggcaaaataccgacgatagacgtgacgaagaccgcacagaagccgaccatgcaacggcaaggaggtcgggaccatcagtgtcggcccgagcagccgggaccaaccaaagagaccccgtcaaccaacctgaacgaggaaaatcatcgatggtcatttcacataccgcggaggaaagaccgacgggggagatagcccgtcgtctcggtgaaggaaatggtgcgtataggaggaagtatagccggggtcaccagaataatagcccgttcgttgaccatatagtcaacgccccgttcttggaagactttgatgggtctttcttgaataagtacaacggaagtcaagacccacagatgcacatcgatgagttcgatatgcagatgtgtgtgcgaggaatcgacgagccgatcatatctcgaatcttcgcgacgaccttgacgggagccgcccagacttggttccactcactgccaccgaggaccatccgcaatttcgaagattttggacagaaattcttgctaaatttcgcaacaagcaagaagcagcccaaatccgagttcgcgttgggaaagatacgccaacagcacggggagacactgcaaagttacctagaccgattcagagaggcggcattgcaggttcacggcctggaagagaacgttcacgtttatctcttgtcggcggggctcaacgggtcttcccgacttgccaaatcaatctacaaagatcccgttaaatccctgagtgagttcggcattcggtctcaaaagtatctggagttagagcagatggaaatagccaactcggcttcaaaagaaaataagaaatcgtcgccgccacggaaccgacgaccagataccttccacgtcgggcaatccagtcggcatcccactaatgcagcggtaggccgaccgccgcgaggatttcccgacaatcgtcctagaccagggaagtatgaatcaaagttcgaaaggtataccccattaagcgccagccggggacagatttggaaagaagtggccttcacggaaatgagaaaggtcaatcggcctcctccagtgatacgaaaggaagggatggactatactcggtattgtgactttcacaatggaccgggacacacgaccgaccaatgttgggaactccgagacgccatagaaaaattcgtgcgcgaaggcaagttacgccagtatgtaatccgaacccaggggcaccaagccaagagaaaagcccaacaggagaataagccgcgagacgacaagaagagcaaaaaggacgacgaattcccagaacctgaattcgaatgcaacgtcattgcaggaggattaggaggaggaggcgatacggcaaatcagcggaagaaatatctcaaggaagttatgtcggtaagagaccggccaaagttcaaacaaaccgacggcggaggcaacaagaaagacacacctccattgatctattttaccgatgaagacttgaagggagttgtgcccggacatgaagacggtctcgtcataactgggacagttgctaacttccgggttaagcggatatttgttgacaacggcagttcagcagacattatcaactggagcgccttcaagaagcttaacttgaaggaggaagacctgaggccgtgccaaacgatgctgtatggctttaacggcgaaggtaccggcctaaagggggtgatcgacctccagctgacgttgggaacgagagaaggtttcaagtcggaaaaggtgacgtttaccgtcggagaattcccgtcaccatacaacattatcctggggagacccacgcttcataagtgggatatcctgatgtccacaaagcatcagaaaatgaagatggtaggacaccttggcaaagtcattacgatttgcggagatcagaaagagtcccggcagtgttattacaacacgatcagagaaacggagggcggcccttcatcaccacatcgagtacggccaggagagcaaagaggatcaaaaaccgaggaacagcctcctcggaaaccgatcaatttagtagaacttgatatgcgagatgtagaggaatggagacccgagccggcggacgagcttgaagacatccagatcggcgactcctcattccaaaccaccaagataggcaagcaggccgacccagaagataaaggcaggctcatccaatgtctgaagaaaaatcaggatgtctttgcttggaaagcatccgagataccgggaatcaagcccaccttttgttgccacaggctggcaatgtatcccggctctaagccgatagagcagaaaaacaggaagctcggtccagacagaaagcaggcgttgaccaagcacatcgaagaattgctcgaggcgggatttatcagagaaatccaatataccacctggctttccaacgtagtgatggtgaagaagcccaacggaaaatggcgggtctgcgtcgactacaccgacttgaataaagtctgtcccaaagactcataccccatgccgagcattgatcaactcgtagataactccgccggtttccagctgctatcattcatggacgcttactcggggtataatcaaatacccatgcaccccgacgacaaagagaagacggcatttcgaggtattagtgctaactactgctatgaagttatgccttttggtctaaaaaatgcaggggcgacttaccagagaatgatgaataaagtcttctcggatcaaatcgggcgtaacattgaggtatatatcgacgacatgatcacgaagacttccataaccggggaccacatccaggacctagaggaaactttccaaaagctgcggcagcataatatacggctgaacccgttgaaatgtgcatttggagtaaaggccgggaagttcctaggttttatgttgacccaccggggaattgaagcgaacccggacaagtgcaaggctgtcctagacatgcaatttccgaccaacaagaaagaagtccagcagttgacgggaaggatggcagccctgacccgattcctaccacgatctgcggagaaggctcttccattcttcaagcttttaaagaaggaagccaagatcggatggaattcgacatgcgaagaggcattccaacagataaaggcatgcttggcctcaccccccgtgttgtcaaaaccagaaccgggggaaacgctcatcctgtatctctcggtcggcgaagaagctatcagtgccgtcttggtcagggaggtggataaaactcaacatccggtttactttgtaagtcgggccctcaagaactcggaattaagataccagaaactcgagaaagtggccttcgccttagttaccacggcaaagaggcttcgcccatacttccagggccataccgtcatcgtccgaacaaatcaatccatccgacaagtgctgcacaaaccggatctggctggacggatgatgaactgggccatccagttgtccgaattcgacatccaatacgaagcccgccaggctatcaaatcgcaagccttggccgactttattacggaattgacaccaacgtcgcccactcagcagaaaaacaaagtctggaaagtatacgtagacggctcatccaacacaaaaggaagcggtgccggggtcattgtcgaaaaccccgacggggtatccctcgaacagtcccttcagctcaattttccgacctctaacaaccaagcggaatacgaagccttgattgcaggtttgaagcaggttaaggagcaaggagcaacaagggtcaacgtcttcaccgactcgcagctggtttccgcgcagatcgaaggcagatatcagactaaaggtcccttgctagccaaatatttggcaaaagtgaaggaaattatggcggaatttgacgaagtgatagttgcccacatcccgagggaggaaaatacccgagccgacatcctctcaaagttggctagcacaaaaggggcgggaaactatagatcagttatccaacaggaactcgcccgaccagcatgcgtcatgatcatatttatcgcgaacgactggagaagacccatcgtcaactatttggagcaaggaatcaccccggacgaggagctagaggcaaaaaagttaatccgagaagcggcgaggtatgtaatcctcgacgatgaattataccgccgaggtctacatagcccactattactatgtctgaactcggatcaagccgagtatgtgctttcggaaatacacgaagggattaacggacaacacatgggcgctaaggctttggcactaaaagctctccgtgcaggctatttctggccgacgatgaaagccgacgcaacggaacacgttaaaaggtgcgacgcttgccaaaaacatgcaaagatagtatggacccctccgtccgagcttagtttgatcactgcaccatggccgttttacaaatggggtatggatttgctgggaccgttcaaagctactgagggtcaaatgcgatggctaatagtggtcgttgactacttcacgaagtggatcgaagccgagccattgtccgccatcacctcagctcgggttcaaaagttcatggagcgggctataatagcaaggttcgggattccggcggaaatcattaccgacaatggaacgcagtttaccgacagaacattccaagcaacgatgaccggcctccatatcaaacatcattttgcttcagtagaacatccccagtccaacggccaagcagaagcggccaataaagtcatccttgatggattgaagaaaagaatgcatgaagccggcccgaattgggtcgagcaactgtactacgtactttgggcctacagaacgacgacccaaacagctactggcgaaaccccattcaggatgacctatggctgtgaagccatgattcctgtagaaatcggccaatcatcatggagaaggcggcatatatcacaagagagtgacaacaatgctgccttaaccgccgagcttgacttgatagaagaagtccgcgctgccgcccaccgtcaggacctccatcaaaaaagcaagctggcgcaaagatttaataggcaagtgaagccgaggtcctttgaaaaggacgacctcgtgttacgccgagcagatatcgggaacaaaaatgctcgagacgggaagctagcggcaaattgggaaggaccgtaccgagtaacccaaaatcttggccgaggagcctacttgttggaaacattgaacggcaagcaagtccaacgaacttggaacgcagacaagctaaagaagtactatagttgacaagaagcggacaaggtccatgtgttttcctttagttggcttctagtcggtcatcgggatcatgaaactccatcatgtgtttccctttagccgaccttaagtccgtcatcggaatcatggacaccatgtgtttccctttagttggccctcgggcccgtcattgggatcatggcattagtgactttcattagattttgtgaaccgggaacatacacccgcgcaaatctattttgaggtcaagttgaaatttctttcatgtttgtatcaatcaattgtgaaccgggaacatacacccgcgcaaagatgtaattgatatcatgaactattaataaaatccttaatgcaaggaacattcttcgtgcacgaattatgagcgcttagtcgttgttttatattaactcggtcctgatcaggccggcgtaactattcaatccagggtgaatcatcggatttttccgaaagaattacatctaaaggataaagttatgaatatattaatagttgctaagacgggaacatgatccctattctatttttaataccgattgaataattcgggttaaataaaatatggctaaaccgacgataataaccgactagcaagttggccgttggagccaatatacggtagaaatacacagcaagttataaaagccgacgaaatgtactttaaaaagtgcaaaaatacttgttcaaatacaggaaaaggaattgttcaaaatatacaaaatgaaaccggcatcccggcccttcagttcccgccgtcaactggagtcccggcctcctcgggtgcatccgtactcgcctcttcatcctcgctgtcggaagcggtgaacagctgaccgttcccgacataagatttgaagtgcatacccgaggtgttcaactcaatgccggggttcaaaaagcgaatctgatccaaagcattattaaaagaagcttcggtagacttcgataattgagccctaacgaacaagagttcactcagcatctcggaatgctccagggacttcttctcattaagggcaagcagctgatcgcaacgatcgcgagcctcccgagctctccccccgttagccacgagatcctgctccagctttgcaacggcggcacgagcagagtcggtctccacccgagaagcctcaagagctgctcgggactcctcaagatcggcggtcagcttggccaccgccccctgcgcctctgcggcctccgcccgagatgtgtccacctctttgagagcatgatccagctcttgttgaagccgttgattctcgaccttggaggcctcgaattcagcagacatcatggcggactttttcttcagcgcggccaagcttcttagcaaggtggcggtcttcatacatgacacctccaacaaaccgagttcttctaactcgggagttgaaagaggaaccatgtcagaatatttcctaggggcccgcaccgccgccaagaggtccgcggtcacaccatgggtccatagagaccggggagacagctgctgaggatcctcggtcggctcgcactccgaggaaggaacagcatcctccaaaaccggagcatccgagggagcgtcgtccgacggcccatccaaaatgacgacggaggtttcggccaccgaagcagaagggagaggagatgcaggggcctcggcggcaacctcggtcgaaaccggggcgacttcagagccaccgggtgtggccttactcttcccctcggccaaccttcgcctcttccgagattttaaggcttctaggtgggggggtcgaggaggacggccggggttcatttcgacagctgcataaacatcaaagtattagacatcaagaaaaaagccaatcattcaagatttattttcaaaaggcattaagactgaccacaccgaacatagtaagatataggggtcaagtttcccgactctttgtaggaaattattcgggcagcagacgtggcgtcagaatccgacaactgagcctcgtcggttcggtaagaggctgaaggaaggtcatgatggacggaagaccaatacaggggaaacttccaggattccgaggaagacccaggagggagagcaaaaaagggacattgaccaggttcggccacaactttaaaaaatttatctttgaagcccttaaaggactcagcgtatagagaaaaaagccgacgatcagaacgatgatcagtacgaccccggaaagaagtccaaccttttcggtcggcaggttccttaccggatcggtttgtttgaaccataaagaaataaaagaacaaaggacgggtacatacaagttccagtttttgacagagaatctcgaaggcttgcataaaagcccagccgttcggatgaatctgggaaggagcaacttgcagatgactcaatacctgcatctggaagtcggtaaagggaaaataaactcccaaccgagtgacgacatctttataaaacagaaagaagtcggggtcattcccctctcgggaagaacaaattggttcacccgggcggggaagacagacgtggaaaccttcttgaacccccaaaggaattgaagcaaggtcctcggaatccatagtagaggtgtgttgtagcacctcatgggttacccaaggaaacctacctgttagcgcgggagaaggaacttgaggccgagacccagttgcggattcatcaacacttctggcccgagatgagtccataatcacctacgataacaaaaaagaattattagtgaagtacctgaaagggtcgtcaaaggacgaagagaagaagaggtcggaattggccggttagggtcttcagcagaaatcggttgttcaacagaggtcggcatcccggtatcacggctcggttgggtcggaggaatatttgtttcttttggaacagacttacgaacccaaacagggttatgtcggcatcggtctaacactccctcggcttgcctatcgtggtctatgctggcgagatatataaactcctctatacaacgtggacagtgttcataccgaatcactgaatccgtttcgggtatcgggtaggcttcggattcacccagagcagcagtatctggaggaggggaaaccctaggagaggccttagattgcaaagcaaggagcgcgggtctttgtcgggatgatgatcctaaactagaaggccctaacctagaaggccctaatctggaagggttaaggggtctaggaagggaaaccctggaatttcctggggcagagggagccctaagcagagactttcttttttcctcctcagaaaggggcaatccaaaaagccaaaaagcagtacgaggagaaaccgttttccggatttcctcttcttgctcaggggtatacttcatgcttaaggccaagaaaaaggaagaaaagaggatgaaaggcagagaaaggaaatgcaaagattaagaaatgctaatgatgaaatacgaaacagtaaagtggcagattaaagagacgcgcggaatacctggaaaggaggaagaaagaagggttgatgatcagacacgagcaactcagtgaagcaatgggaaaggcaacagcgatgaaggagacgaaagccaggaagaagaaacgaagaagcacagtaaggagaaaatgcaaaagtataagagacagagaggaatgagaattgaagtcaggtttaatacgatgaaaacagaaaaggcgcattaaatgaaaaagtaaccgccagaatttgaaatcataagtgataactgctgggtataggggcaagattgtcttttagccccaaaagtcatgattgaaaatcagcagttactaagacacgtggcgataaggaagttggagacgttccattcccctaggtcagtagcggcagaggctgcattgaaaagacaaggagtagctcggcgacgatattgaagtgattgatgaattgacagaagatatgatatcccgacaaggggcatcgatactatacgacaatattgatcatggttatgtcggctcggccttgatcgtgtcggctcggatagtgtgtgcctcggctaagtaaagataaaacggctcggacaggggtcacctcggaacgacctcgatcgcctcaatacaaatagagatgacctcggctcggatctcaacttcctcggctcgggtggtgagcatgtcggttcggatgatggtcacgtcggttcggatgtcgaactcggccctgcgtgggtagtacctaaaaagcatagtcggcagcattattgatacatcccggccatccagaatgctagaagaccgggctgaggggcatctgttacgggataagtttgttatctccccctttaaagcagtcaaacgactgatagtggcccacagtaaccaccccgaaaggtgggataagtttgttatctcccacgaacccatatctccgcatatcaaggagaacggtttcaagcttaaccgcatggcataagatcgcgagcttcaaccgcctcatgggcaccctggtataaatacttcttcagtcatggtgaacggtacacattttctagctctctcttttccttcacacctgcacacactgcacccactcaacgtgtcgtgttccttgtgcggtgatcttcttcctcaagtggcttcgtattcataagcttcttgagagagagagagagtttgatcctacattaaatcctccaacaccattgttggacatttctgttctcaccgagcagaacagtaacgaagaaatcttaagagataatttgttaactatttttggaaaaagaaaaagaaaactagaggttagagttcaaggaattaattagtttaatatggttatgtattatataggtttatcactatgtatttatttgccgtaagttgtctgagctgtatcctgcaaagggattgaggaaaatttacgcgttcaacattcaatccgcacaaaatcatcattttattaggaacaaactcatacagttttcttgaagaacttacaatttcgcaattgaaagtacaagagaatcagtgtattttagattttccaagcaagctggatttgtgttgtattgtttactagaagccatactaattaaggtagtggatataaaatgaagcaggaattcaacatgctactctttcttacagagaattgacatatatacaatcataggggtttgagatgaaaccttcttttaccagaaaaaagatatcagcatgttttcagtatttggtacagtagatggagacaagtttgttttctgcaaattttcaataggaaatggcatgaaaggataaaagtgaaggtatttttttctaacacttcacgacaaaacaactttcaaagacagtaggaagactccgttctggtctctttatctatgggtcgtcttgcattgcatatataagtttctaattaaaatttgatttaactttcgattttaaatcataaactatataaaataaagatgttttttataaaatatatttaaaaataactgtaatctttgttcatctcaattaaattttgaaatttgacatatactatttcaataaaaatgacgtgtcttgattcaagtaatttatttatctctttaatttattatttaataaaattgattatttattattaataatgggaaaatttataatttttatttatatataatacaaatatgtttttttttgcaaccattttttcctctttagtatcatacataagtatacaaaattaataataacaatgatataagtagattagattggccaactcgatcataccccaaagttaaacaaaatgattgtcctcaaacatttgaaagataaacaaaatgattgtcctcaaacatttgaaagagtggaaatacttcacactttaaacaaaattttattaatcactctaatttagattaacatgatctataaaaatctactcaacctcaacaaaagagactaagctaacataaagaaaattgaagagaaaaaagagaactccataaatccttaaagagacatgacttactacattcagactcaaactcacactaattaacttgagaattcagtccttaattacagctaacattctcatttatgatattaagggaccaccatcaaagaattgcatttagcatgaccccaaggttctcattcattatccttgagttggtgtagaatattttgtcattccttttaagaagttttttggcatcttgatgaagggaagaatcgacaatgtcgtttgttttagaaaaattcttgtattcaccttatagaagacaatctaaatagttgtcaaacatcatgattatcttttttataggaaattgtaagtgtcttaactcttaatgaaagaaacattcaaaacactgttaaacataatacttgtcatttcttttaggaaatttttactcgttttaacaggttaagacttaaatttgaaataggaaagtgacaaggtaaaaaagagaaaagtagtaacaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcgactaagaaattttttaagagattgattcgacaactaattttgttttttttttaaaaacaaatttaatctactatatatatatatatgtatgtatattgtgtgtgagagaaatttgtaatacgggggtgataaacgtaacaactccatattcaatcctttctaaataataaaattaataataaatataattaatatcgttttatttttattcattaataataactatcttttaaatacttaccttaattataatatatttgtttcagcccaattagtaaaataatattttgcaactaaatttttgcactaactatataaatttaatttaatttttaattttttatataatttttattttgatttatcaattgatttttaaaaaagtttaaatatatttttagtctttataatttaaagcttttatgcttttagtttttgtaaaattatttttatttccaatcctttcaaattatatttgttttattttttgtgtttgtaacattttagataatgttttttttacagtttaaaaaactatattaagtattttaaagattaaaaataaaacaaatataatttataaatattaaaattaaaataatagttttgtaaggacgaaaaggaaaaataataaattagaatgacaaaaaatatatttaaacaaaaaaaaaactaaattaatacatgtataatttagaagaaataaaattaaaaaattataaatgtttagactttttaattgttggcaatataaataaattatctaagaaacaaaattattttgatatgaaacacaggcaaaggaagaaaaagcaaagaaagagttgaatcgaaatgaaagcctttgaggcagcgtaggctataaatagaagtttgtgaattgaaagggttgtatccaaaatcctctctagttttgttgttgagttgaaaggatcaatatgaatcagaatgtttggtggcttctaccgtcatactttatcttccttctttttctttttcttccttcttcttcctctttctgcaaccaccttgacaactctgccttgctacttttcaaaaactcatttgctctcaacactacacatgattattattgttcctctttttcttcaaagacagaatcttggaaaaacggaacagattgttgtgagtgggatggggtcacttgcgacatcatctcaggccacgtgattggtcttgaccttagctgcagtaatattcaaggtcaactccatcccaacagcaccatcttcagcctaagacaccttcaacgactcaacctagcctttaatcatttttctggctcttcattatactctgcaattggtgatctggtgaatctcatgcatctaaatttgtcatactctggattcactgctcacattccctccacaatctctcacttgtccaaattactgtcacttgatctcggtagttatgggaatgaaggaccgagaatgagacttgatccatacacttggagcaaactcattcaaaacgcaactaatttaagagagcttaatttagatgacgtggacatgtcttgtatcggagagagctctttgtcattgctaaccaatctctcttcctctttgatctcccttagtctcggagacaccaaattgcaagggaatctgtccagtgacatcctctgtttacccaatcttcaacaaatatatttggatcataataaagacctcggaggtgaacttccaaagtcaaactggagtactccactaagttgcttgtatctctctcagactgctttctcgggaaacattcccgattccattggccatttgaagtctcttgacacactatctctggggggttgcaattttgatggactgcttccctcatccgtctttaatctaactcaactctcccatttagatttaagagagaataaattagagggaccagttccaagggaaatcaataaactttcaaaattgcggtatctatggttgtctgataacaagctaaatggaacaattccacgttggtgttattctttgccttccttgttatatttggttcttagcgacaaccacctcacggggtcaattggtgaattctcatcttattctttggtacgcttgtcactctctaataacaaactgcaaggtaatttgagtggtcatctggactttcatcatttttcaaagttaaaaaatctatctagcctcgatctttctcacaatagttttctctctattaactttgatagtaccgctgactacatcttacccaaccttgaattcatatatttatcttcctgtaatattaatactttccctaaattcttagcaccacttcagtatctggtcggactagatctttctcataacaacattcgtggaagcattccccagtggcttcatgagaagctcttgcactcttggaagtacattgatcatattgacctcagtttcaacaagttgcaaggagatctcccaattccacccaatcacattcaatactttttagtctccaataatgagctgaccgggaacattccttcagcaatgtgcaatgcaagctccctctatatactcaacttggctcataacaacttgacaggccccattccacaatgtctgggaacatttccttctctttgggcattggatttgcaaaagaacagcctttacggcaacatacctgggaacttttctaagggaaatgcactggagactataaagttgaatggcaaccaattggatggaccattaccaaggtctttggcccactgcaaaaatctggaagttttggacctggcagccaataacatagaggatacatttccccattggctagaaagcctccagcagttacaggtactcagtttgcgatcaaataagtttcatggtgtcatcacttgtttcggtgccaagcatccatttcccaggctgagaatttttgatgtctcaaataacaattttagtgggcccttgccagcatcatacatcaagaactttcaaggaatggtgagtgtgaatgacaaccaaactggtttgacatatatgcgtaacagcaaattatataatgattcagtagtggttgtaatgaaaggtcaatacatggagctcaagaggatattaactatcttcacaaccattgatttatcaaataatatgtttgaaggagaacttccgaaagtcataggagagttgcattctctcaaagggcttaacctttcgcacaatgcaatcactggtaccattccacggtcctttggttatttaagaaatgtggaatggttggacctctcatggaaccagttgaaacgagagattcctgtggctttgatcaatttgaattttctggctgtgttgaacctttcgcaaaaccagtttgagggtatcatacctacaggtggacagtttaacacatttggaaatgattcctatgctggaaatccaatgctatgtggaatccctttgtcaaaatcctgcaataagaatgaagagtggccaccacattcaacatttcaccatgaagaatcaggatttggctggaaagctgtagcagtgggatatgcatgtgggttgctatttggaatgcttttgggatataatgttttcatgactgggaaaccacaatggctcgcgagactagttgaaggtatgcttaattaatgaagagtgaaaaggacaaatcatagtggaaggaaatagtttacccatagtttaatatggttcttttgtgtgttgctgtatgttttctgtaattttaacttctgtcctttgtgtaacaaattgttggataatttccgtttttagttgattgataatcttatctttatttggtaagatatttatttggtaagatataatcttgcttttatttgataagatataatctttaatagatatcttttatttgataagatatatttgatggcttaggcccaacccatttcatcctataaatagatgagtaagggtggaggcaaaacacacagaaatttgagagcctcaagtgacagtcttgagtgtcatatttgagcgagcctgcgtgctctgcatttgagagattcttagagagtttaagtgaaagactctaggtttcgtttgagtgaccaccattattggagaggttgagtgtaccaccactttggtgtgtttttgattcattgtaacccatatttgttatagtggattttgatactagactaggtcccgtgagtttttcttttctcacattgaggaaggttttctcacgtaaaacagattgattgtctctctcgctcccttttgattttattccgcttccgcaatttgatatttgaggatccgagattacccaacacaaatctcatctctcttgagtgatgtatttcaagttatttacaaataagaaaaaaatgtgatgatcgtaaatatcaaaatgagtggtcttcacatgtgatgttattagctcaaaaactttgattctaatctccaaagataaaaacttactagcccaatagccaccacttgtatatcaagcatgccatagtacgagctaagattaaaactgaacttttaatttaaaatttggtttctcctaaccccattacatactttctccaaacaactatccctaaccaactcagtccaattattaatttttgctgcatgatgatcgtagatgcgccctaggccaatgtgtccccttgggaggttccttgagtgaaaataaataaaacaaagtcaccataaaaatagccttctaatgctctaaatgctggcacctttgggaggctttcattaatttggaagttaaaacgatattggtaaatatttggactaataaaatgaaacaattattgatcatactagtattcacacagcaaatatgtagcaattgttcttgaaatcaaatttattgtctgacacaatatccggatccatgtatttctgggattggtttgtatagggtggttttttttatcaatatatattaattattagtattgttaatttttgtgtagaaaagttatagcttgtttatttattggatgaattgtttttatatgtatacataaattgtatttgttgggttatccgatgtatcgatattctctttctttaatgaatattctttctttttttgctaggaaaaaaaatagtacagtattagaatcttaattatttagttttgcatatttcaaaaatttataagatccaaaaaatgaaataaaaaagggtgaagttttaacggtaatccaaccaaatttgcacttacattttaatgtatatgaggatattaactacttaattaactaccttcacaactattaacttatgtttgtcacttcttctcaagatgaagttttaacaataattcaaccaaatgtgtacacaagtttagggtgcttgacttaaaaccttcttcaagtgtacctgttatagaaatagaaacatatattgaagttgacatactgctcttcccataatattagctaaaagattctgattatcagctctaaagttaaaaatttagaagcaggagcttataacaagcaaggtaggtcctgagattttatgacaaaatagatatataatatcataacaaatatacattttatttcactagataaataacataattttaataaattttaaaaaaatatcatattttttatttaagatactcttatattattatctattattctatttctatctctaaaaaaattaaatacacataattatttatatataacatatacatgacaaataagggacaagatggaaagcagtgttagactctctttatccacgtccatgcaaaaggtaagaatgatttaaaaaagatcattttgtattttttaatccaatttactttaaattatatttttttaaaatattaattaaatttatgatttaatttatttttttatatttgatccttcaaaaagaaaattctctatctacatcattatcatctatcattgacaaaatatcatttcatattaaagcttagatatattttattctttatgaaaatactaattttagttttatttattttataattttaatttttttgtgtttcttcaatatgttgatatatcaacgaattaaaaattcaatcaatatgaatatatgattataaaatgttagaaaaattaattaaaagagtgtcactttttaataacattaacacattttaatttaaataaaaattgaagcgtaaaataaataacaactctagtttatttataaaaataatataaaaaattattataaaactataaaattaaattaaattttgagtcccttttaatcatagactcagtgtcatcatcgcacctccagacgaccctcaggtcagccttaaagcattgataatttggtatgcatggactgaaagttaaccaagtgggtctataagcatcaatgcatcatcatcattggtgtcatctacggaaaacaatactgaacaattaatgtaggaattcgtgctaattctcttgaatggcacttctcatgagcattaaaggccaccggtattggagttttgaggtaaatgaccaaatgagtgaattggaattttatgaaaatctcatgtataacgcacaacataaaaccagagcattagatagcttgaagttcactattcaggtcaaattttttctttatgtaaatcaaaatctagagaatttttcaatgaagtatataatagaaatattcaggtcaaattttgacagtctgatccgtgaaacaagttttctagcattgtgcagtttgagatctgatggttgatgatgttttaactaaaaaatattacttttaaaaactccctcttttcataagttgagataattttataagttgttttttttttaaggaaaaaaaatccttctctttttttgtttaccaaagtggatggattaaaaaactgtggaccacgtgtttttgcagtcactttccgttatatcaaacagagcttaaaaacaatctatttcaaggagaggtaaaaaggatcctcatcatcccattatttgtctagtaacaatattaaactgctcatgctaagatgcaatttttcaagcgatccatgttcgtgagaacactcaaaaaatcttgaaaacaattgaaaacacaaattcggtggttgtagggatgatttgcataaaatcatcccgcacttcaaattagacgcgcaaataaccaaatccatcattgaatagtttttagtacatgtcattgtcaaataattaaacagcctattcctcatagcaacaatattaaactacctattcgtcatatttattatccttcacttctaggcatgcaagcaactaaaatttagttaaagttaaactaattttctttaaaaccgtctgcggttttgatttgcaagaatttggtgtaagattgaaatttagtaggtgaatatcggctaacagtccaaacataccattaatactctttttcaatttgtaaacagaggaacttatatacaattcactcatttaagagcattttcggcgttgtttagtctaggttttttaaagtcaaggaattgtgcttaacttgatttatggttggaacaaatgacctagtgttgcttatccaagcacgtttcgttgctttaaaactttttaattaaaaaaaatcaacttttcaagcttacaatcaacagacaaaggagggaagtttatataaaaacaccaaaccaattctagaacagaatcaaacacaattaaattaagacccaaaaattaaaaagaaaaaatacaatcaattttagatctcacaactataaactctgagcaaagaaaggtttatggttgcaagttctaaatttaattgtattttttaataattgtgactatttgttcgaaggagttgagcaaataaaaagtcgcattttcaaatcccaagttattcttatttatttttgtaatatcacaattcacaaggacgtagcaatgcgttggaggctactacacaaattttcttttcctttcttctctagataacgcgtcaagggaaaactcctaacaaaattggctaactgctctattctcaacctacaaacaaatcttccttttcttttcaaataattgcaaagaaaatagagtaatacaaacagctcattatgttgataaatttagatatttgttggattagatttgttatatattattacttataacacttctaaatgaaatttaatttttattattattaatttatgcacattatattattttttatttaatattactaagatattaaaataaagtattaaaattgatttgacttcaactcaatctcaattaaattattaattcttgaattaatgtcttcatcgccgattcaatgatgaatccaattctcacaacattggtttatatcctaattagtgtatctcgtcttgctttccaccttgtgaaagaaaagccagggcagcatgtaatggtacttggtaagagcaataagtgtttgtgccacgcatttctgaaaacatcataaagaaacacctaggatgggtctgtctagaagcattttctgccatatcatctgctattagtagtaatacttttaatacattaattaataaagtgaaactctaatttaacaggagaaaaatgccaaaaacatctaataaacgtatatatgttttctccaattataattgtacatataccaccaaccaaaattccaaaactctaattataagatgtttggttattgaatgagaaacaagatgaaagattgaacaataaataaataaaggcttaaatatgtttaagattctaaataaataattaaattttattttaaatttttaataaaacaaattgttgttttgagtcatattaaaatgtttgttttaaatttttagataatgtcacctcacaaaccgatatttttaacattatcaataattatgagtatttaggaatccggaacaaaatttgatcatttatcatacattttaaacatatttaaaccataaattaataattaactgattgttgtgagccagcatgtcagacaaatgttccacgccgcgatacttaattggctgtggttttagttgatataagagaagcaattgtgagcggtaagcctgattttggatggattgtccaaaccaaatagttgagcccggtctcaagaatggccacaacctccgaatggcatccttactcctgctctaggatatattttgatgctatttttttctcggtttctttatatttgttattagcatttaacccatgatatacacggacataagattaattatacattcacaattatttgtattttatttaaaaatttataaaattgtatgagaagtttaagttgaaatttatcatttttaagctaagcccaacaaggatggaaatattaaacgaagaaatgggcagaactggctaacccaaataccaatgccttaaattttttctctctctaaatttaagtgagatggggggattagtaacagctaggtgaggcgaagaaacagaaaaaagtgaaataaaaaagccacatgagatggagcaaatgatgcggcaggaaactatatttttatgctaacggggttataccgaggctggcgagtctcttttacaacattacattaaatctgctacaccatttagcagccctcacttaaattaacactactgactgaacaaaatctggaagcaatcaagatgaacaaaaaaagagtcgaccaactataccctgtatacactcactaatccaaaaatcttatgtactgatacagtgcagtgatgatgatcaatgacctcaacttgaacaacttccacacagttggaagtagtaaagctcaacaggctgtggtcggcagacagtgttgagatccgttgacagaaagaattacataccacaattctaatataaaacctgcagaaaccacctggattgctgatctcactaattgtggcctatacagagtagcctttcgctattttccctgtttttacaaaagcccgtagatgtagcagaatatgccaaattcatcccacgcaagacgagaactcatcaataccagtttcctaattataaatctttactggcttctcgaaagtgtgccgattctgaaacaaaacgcatgcaatttgaaatggtgtaataaaacaaagttctctcaacctcaaaactaaaacccagtattaccagaatagtggacaaccacaaaacaattagaaagaccaaaatgaacttaataaaaattgctcttgcaggctaagttacaaacctggttaacagcatatgatcttttaggagcattgtcagtatgctccaagccaagatactgctcccaagcaccataaacatctctcctctatcacaagatacaatgcaagcataaattcacacatgaaaatgatgctaaatatcaattgaattatcacaaaaaaaaaaaaaaaaggaatccaagtataaatgaattacctgaaaacgactggatacaatgtcagaatcctgaaggtattcaggacgccctaatgaaaaaaaggcaaatttccactggccaaacaagaaacataatataaaaattagataaattaacaacaaatttactaactaatatttataaacaatgaaccttccatcattcaaagaaaaattacttgaaaaagaagcataatatacccatagaatacactaagaggaaataccttgacaaactcatcatcaggaacttgaagtttcttctgtattcttactttaatttccgccaaagtctccccttcatgtatgaccaagaaaaagggttccccaaagttctgaatttgctgtcatatcaaatcaaatgggaaaaaaaagtgacaaaaaggttggaatacaactaacgtcagaatgaaatatcaaagccatcaaaatattacaaactccagtaagcaaaatgaatcagttaaaaattatataccatttggttctgagctgtgtctttagtgaaatgatacacatgaattagacgatcatgaggacccagatttttctcttcttctggtatctggaataccaagaaaaaagtgacacatttattttgatacataaactgaataaataaatgaaactataattgagtatttagaaaaatccactggtgcaatcatttcaataaataaaagcaggaagaattcatggactgaaagccatctcccttcccagcccactcaaaaacacaaagagactactacctcctctgcacgtaatgtccagtattgatcattaatgttttcaatcttttcattgggagggaagacctgcacaagcagaaagacaagacaaaatgaacatatttcaataagaaaattggactaatgtcctaaaggtaattgcaatttcagtggcacaaaaaatgggaggatcatgagtcaatgctaaattaagtatattgaattctgattcttaaataattttggtcagaaaaaataatcaagagtattaataaatccaggagcagttaaaatagagataacacaacaccttgtatatcttgtgatagaaaacttcaagcaacctaagctcggcttcatgatcagacaattccacctgtaaaaaatgagcacaagacatatttcaaaaattaagctgaataagcataactgaggaaaagacaagttgacaacattatgttaaaaatttactacttcaataactaaatgaagtactgaacaaaaccgacaaacatggcttcatgtatcttttgtttctaaatacagaggaagccatgagtgcacgttggttgtaattgtgatttcagtgatgagtaaatgtacagtttaggcatgttgatgaactaaataatactcatgcacaatgacctttgttttcagatcatcaaggacatcccccacagtgctctgctttgggagtctgatggtatgaataaccacctgaataaacaaataaaaaagtgtcatggaaaataatctagataaaaaccaaaataaaatcagattactatatactcacttcatccttggtagcatggtgaaatgcaactttcagagttttcaatccttgtaattctggcagagggatgtcaagtacttcatagtacaatatatccgaagtctgaaatgcatgaaaggaataagatgttttgctttataaataagaaacaagttgaaagttgggacaagtcaataattacctgattgtagtgaaccagcatatcagacagatgttccacaccacgatacttaataggttggggctttggttgttgagagtagcaattatgaggggtaagcctaattatggatggatcttccaaaccaagttgttgagccactttctccaccacatcatcatatgtatagagccttgacctagaaaatatacatagtataagatgtggatgcaaatctaagcataataatatataaatacttacatgtactctaaagtaaaatattgcaacatattaaatctaatgatttgctccaataaattacacaatgcttacatctccaggcagaagtcatcttccttgggcttttctagagatcgaaagtgaacaacctaaaatacataaattagacataaaagaattagcagatatcacacggtaaaaacataatgaaacttgcatggtatattggttacacacatacagatatgtgcaggcgtggacaagggggaaagaggaggaaggggcagaataatatgactcaataaatgggtagagtttcatttttgcatatcaatccatacaaaatgcctttaattgaacaccaaaaagaaaaatacctggcgattgtgcacatattctaggtatgaaggcacatctggatagcggacatgttcactatctatagcaggagctttctgaaagcatataatatctccgtcttctaactgcaaatatagaaaaacaaatcaataaaccaaccaaagatacagtaactcaaagtgcatcaatggtgtttataatttacctggcttgctcgaaatgtaaatttcttatcaatgggttcacacataacatttggctcaaacttaatttcctgcagaataatagtaggcacgttaaattcacaaatgccacacaattcaagtcactcgttgacatcagaacctaaagatgaaaaataaaaataaaagaaggtccttctttagaggtcaggctcatgcagaatagatctttgttgttgtaacatattgcactttatttgtcatcaatcatcagtaaatttaattattaaacaaaagagactaagaatgctaaatccaagcctaatatctcaagaagcatattgtgtttagatcatacaaggatgaactacagtctcaattttcaaggcattctgcaactcaaaatattaaacaatagaacacaaacctcatatagtccaatctcttcatcaggatcataaccagccattttatttaacctggttaagatttctgatggcttaccagtactcttcacaaagagccttccaacataactgccacaatagggaaatacatcttatgtcaacaaaggttcaccttttaccacatccgcatgttaaaataagacattactcagtaccgtagctcctctttttcaggatcatataacttgaagaacagtaatatatcatcctttgtcttgtctggcggtgcaatgggacgtaaatcctaaataacaacatagtttgtcaaaaggacagaaattcggatattaatggttcatgctatgaaaatggtatgcaacttccataaatacaaatattaccagcccaagctccacttccaaaagcaatttcaattctgcattgtgaaccttgtttgatacctctctcaattgtccaacctgcaatgcaaatcagattgagaaaagacaaaatatataaatatatatatatatatatatatatataaaccttcagatcatatagaaagagacatgccacaaaattaagtaccaaaagcgggaagatataaatcacagaaaagttagcataaccaacggcataataaccaaaccacaggatccccaaaaaatagtatgaaaaaaactttatactggttgctttctttattcattttcaggaaataaaaaacaattagccaacaatggcaggcataaagtaattataagcaaagccaacacggaataacctgttgggacagcccacgaaattgaatataaaataagcaaccggacaggacaattatgaaattggcatgttgattaagaaatgaagcatagaacagattcagcattcaacaagtgcagggtaaacaggcaattgatataaagctcaaaggagagtatctgagaaaaataatatagagaagcttcaagcaagctcaagaatttacagattgtgcttcttccatgtgtgtcaatggtcgatttggacgatacgtatggttttgccgctttgcccatagccaaaagcgctggaattgaactggtatgccaaactctttagcaacctcttcctgcgtatcccacagataaaccagcaatcagatttaaaaaaatcaagcttatgaaaatagaatgtcttttgagcaatcatctaagaacaacagatacttctaaatagtagatgtatcatgtcatagctgttaaatatctatccacgctaaacacttcataaatacttgtacacttttagatgcatttatatattttttttacttttctttaatttttatgcaaattaaattaaaatagcataataattagataaattttaacattttattgtgtctacaataactaatgatttttcaaacatgaactctctttttagatataagacttttatttcatgttaatattaaattgatttgatgcatttatattataactgtgtttagtgctataatttttcaaatttgctgtgcccccatgtctgtgccaatcatatctgtgtcccttatcacttttgtgccctttcttctaaaaaaatttctgaaaatatccatgccaagaaacttgctgatttctatcgtattttggatttattttccagtcagcagcatttatacaatatttttctgtcaatggataactacaatatctccctcttaaatgagtcattaacaaataagtcattttgtcagaaaactagattgtcctatattccaatattttcaacaaaaaagcaaccgcttaacaatagagatttactagagaccaaatcaaatcagacaagaaacaaatagggtatgccaggtcaaaacacatctagcaggagagctaaaagtgtgattaatgatgataccttaaaaaggttaaaagacgtctgtttttgaacacggaaactcctcactttgtcatggtctacaagatcaaaatatatatcctttccaatctgctctgcaaggtcttcatcacgtgccacctaagaagtatcacatgttaacagtttaggattaagcaacccacagcatctctatgtgaggacacaaacagtactcaattctaggatagcaagttaggaactagccaactacgaacctttataatagtgtaaaggtgagcctctgctttttctttctttttgtgctctttttcttcttgttctttcttcaacctctcctgcattaatccattgtagaaattcagtgcaaattttccagaataaagcagtagaaatagtacaacagaaatttaaaagacaacagcaaagtgagcttggtttgatattggcttgagatacacccaaggaatttctcgtgagaaaaaacaaaaaatgacttggtttaggcagagtttaaattttgtgtgtaagagagatcaacttacacatagctattcttacgccatcaacaattttaggcagagtttaaattttgtgtgtaagagagatcaacttacacagctattcttacgccatcaacaattttgtataaaatgtgatgttcatctatctaaccgttgactaataaatatatactacctatattattcatgtcaaatccagtaaaaacaaaagataatcaattaattcttattttcatatatttcaaaagcggttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaatggcagcaatgaggtttgaatctagaactccatgcaaactacccaaaccaatcccccacatgaatgaggtatcaaataattttggattaatctaaaattttgcaaatatgatctatttgataagaacttcgattacaatgatgggtttaggaaaaaattgctgaccaaaatgttaataaatagtgtgaaagtaggtgtaacttacactggggtaagttgctcctcatgtatatataaatagatagataacaaacataaaaataaaataaaaaacacagttgagaacttcagcacagtcatcaagtatctgaacagaacatgcttatcttaaaataaattagccatctgcatttctttagcaagttaaatttaaatgcagaagacaaacatgtagctatttgacttggcttgatttattttaaaccctaaagtacctaagaatagtcacttacccttaaatgttcagcaatgtctttctcatccacattgcatattactttgtccttgtcagcttcacgtatatacaccagcatataagcatttgaatatttggtgaatttaaaaggagtgttgttaaatccaggatttgtctgcggtaactgttaaaatacaagtggttaaataaccaagaagtaaatgttcaaatactagcaacaaccatttgcaaaaaagcaattacctcttcctcgccaccatattgctcctctaatgcccgtttagtgtcttctttagtcaccctctcatcatcaaatttatacctaatattcaatcaaagcatgcagtgaagtgctcagtaaagcagcaagaaatgcaaaacaaaataacaaaaagaaggtgaagggactctcagaaagttgcatgttatatccaagttcattcataaccattattagaaatgtagattatcaatctaatgacaagtgtcaaacaaacagattctgcatttcaatcgtttaccactgcaactgcctcatttaaaatataagatacaacatactctcatgcaactaataatggtatcatttacaaactacaaattatgaatatgatttttcagttgaagtttagtccaattttatcatttaggaaatattttccttatctatgtcattttcatcacatatattttataattttatctgtaataagacactcttttttatctctgtaataaaaagctcgtttttgacttacattaattgtggttctgactttcatctatagatcacccttaaaaaatcagtatttgtcacatgatcctgtgtgcgtaacatataatcaatgaatatgaattttcagctttaagtttagttcaatgttataatttacaagatattttccttatctatgcatatttatcacatgtacttttatgtataactttgagcatttttggtagaatcttacgatccatgttttgatccttcaatttacgatcttatgacttatgtaagatctcaattttgacaacattgggtatagctaattattcaagttttctcacaatccaaaaagcatgtgatgtggcccctagtagtcatcatcacacatacacaaaaacatgtagctcatatggcactgaaaaattcagacctaaaagcagagtatacataccactgctcagatagagtcggcctgataaaagcataataatgtccaccatgcacaccaccactgtgaaccaaaacactgtggaaaaaatttaaatctgtcaaataatgaacatcaccgataaaaatatgcattcacataaaaagaaataattgcacactaatggacatcatcagaactaagaaagaaaaattacaatttcaatgaattttattgattaataattttaaagggtaacttttaaactttaacattaacaatccaagtttactgtcccaagattattcaaaaatacaatcccccacttgatttggaaaattcagaaggcctatgagatggctctcccaaagataaattgttttcttctttccattatctatcctcgcatcattttctcctcatcctactttatcttctttttctttctatagattgtagaagccacagaacatggattgtactagactaagtaaatgggtaaaaatatgacaacatatatactgaaagtggcttctaaaaaaatcaaaaacaaaattgggcatcatgcaccaaatcacaatcaccaaataaaatatcatgaaacaaggacaactcctaaagaagtcatgaaaagagagatcactagaagagcagcccaaataaaaaaccatgcagtctgcaacaaatacagctatcattaccactacattacctatgaagtgtgtaaagattgcggacattcctatcagcatcaggtgataaatattttccattctcacgatcaaggtcaagttgcaagggaaactcataacggtcattaatctacatggaagaagaagaagaaaattaaacttccaattacagaaaagggagtttaaccattccatcaaaagagaagagcccatggactgaaaaataaaactaagtaatgcccataatccctctagcagaatatatcccttcaactgattgtttcaaatgacatacatatattttaaatacatgcacacacaaacaaacaaacaaacaaacaaaaagatttcccaccaagacccagagcaaaaataagcaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaacaatttccatttaaaaattaatattaagaaaatccctgcagaaatccttcatgattttcaatatcacaacacactattgtacagcacaagtcgtgccgaatcactttcttacatgaagtaacagtactgtaaattaatacataccacaaataaagaaggatatcactgtagattgtcaagaataagtaattaatttaatcaatataaccttcaatggcattaatagtgagctagagcaaactgactgaaacgaaaccatattactctgactgaatgctaacttcttcatatcctagtaacttgaaaagaaaatatgatatagagcaatgagtctatttgactactaaccttgaccatagtatcccgcataaagtcatattcaaatcttttcagttgaagctgaagaacaggagggaaatcaatgaacagaacacccttcttagcatcctgaaaaaatgaaaaatcatcggtttatacgtgaaactatattaaaaaatgtatagattattgcattctgacagcaactataagaaacttaaaggattcagaacttgacaattgcaaacaaaacgatttttgtacacccaatataagaactaaaagattcagaacttctacaaatgacttattacaagtagattcttaaataaacaattgcaaccaacctgcaaaccatattgttccgcatgatatttgttatccccttcaagacgttcaacttcaacatacttgtcaaaggaagcataaacatcaggacagcctttcacatcaagctgaaggtctgcaagtatatgtaaaactaaattagaatcaagtggcaaggtacaattaaacacatagcttcagtcttaacatggaagtaccataaaatgactcctttctagttgatttatagtccacattgatgcattcgatatagttcatatgatgcccttcaaatagcttctgtatagttccctcaacaacagttccctaaagacaaaatgaacataatcatcatgaatttgagacagtattccacaaaaaagtttgtgtacaaaaaatccaaagatcatcctttaccttcatcttgtcttcaagtttttcacagaggactctgttcagttcttgaacatcatgctgcatgaaagaatcatatgtatcccatccaaaagatttagtgagctcctttgttgcaacactggtgtcactatactggagcttgtagaataaactttgcaaagccaaagggatgcttgcagagggcatgtcattctctgttgttggcatatggtatacagcctgaaatatgacatccaggacccaaatccaaacttcctcatcactatccagtaaaaaaataaaacttctgaagaaaaaaacaataagagaaacaatgcctgacctttcgaaaataaggaatatggtacaaagtttggagtagagaattcatataacatgtagctccctggttcttgagtccaacatagccagtctcctttttagaatcataagtccagtaatcaacaattctacgaacaagaacctcggcttcaactacaagagtatcattcacaagataccctctactaggatcatacaattcaccaagcggcatgaaagatgtgaaaccccaatcactttcccgcgcattgaattggtgctgtgtgtctacacagtgtaaaatgaagttagacaaagcacatggctatgcacaaaaattatgagcattttcactttattcccctgtcacttctgtttcatggtaaatgctaatgagtgcccttagcttagggcacctgttaggaattcaaaaatacaaagtattaaataaaaggtcaaacattttaacctctcaatacattacatgcattatacaaaaacagtttccattttttattacttaacaagagcccttatggaattcattagtgagagtgttgttttatttaacatgttaatgcttacagttcttttaagataagtaatataactctatccagatttagatccaatgttacaaggaaaataatattcaggaattaaatgtttttaaatatatatatatatatatatatatatatatatatattcaagaattaaatgttcttaaattatttgcaacaaaaatcccacaactttctttactcttacttcaagcaatgatcttttctacatacatacacagtacatcatcttgcaacaattgtacggaacaaacttaacagactaccttttctaacagtgtatttattatggatttgattgacgactgccaagctaaactgtgcatatctactccagccatagggtaaactagctgaatctgcaacatccaaatacatggacaaatagtccacattgttcccttttgggaaaattagtacacgcctgcccagtaaaaaacaaggttcagaagagatcattaaagataagcacatcattaatcaactcggacagtaaaagcatcataccatttataaccaccaacaacaaatatttcagaatagagcttctttgtattcatcctagaaaagttgtcaattttccatgtgaaccttgacgttgaaggatcctcaacaggctgactctccacagtgttggcagcatcaggttgagccacaactaaccaatcatcaaaataaatgaaaaagaacaactaagtatcatgccttaaatcagctgaaaaccaggggggggacaataaataaactagaccctctactcagttgcaaggaaagagagagaaaaacaatgataagatcaatcaataaagtcgttgaaaacacacaacctctccaaaatgcaatcaaacaagaaatcactttttgtcaggaaaacctataactctttaagaccaattcgtcacaagttattccctctctgtctctctggcaatcaaacaacgcatgaagtgtctccctgaactcttaagaaagtaagaaactattcaaatcgatcatataaaagccaacaaatagagtaacagaaaaagcgggggtttctccacggatcaaaagtgtgagaaagcaacaagtaccttccatgggttggtgattattctcagccaaatccgtgtgcgggacaagcatctcctcgtcctcctgctgctgctgcaaaaaccaaaacacacaaaccaaaaagaaatcatcactatcaccctacttcggatccaccgaaaactaaccccaatcaaatccccaaattccgagcacggaatgcatcgtaattgaagcaaattccactcgcgcagatcaaaaccacaacccctaacacgaaacccccatccactccgcggcaacccaaccctccccaccaaaacgacaatcaaaattgacaccattcgccgagacagcaaaaaggaacaaaaaccatgcaagcaaataagagaaaacgaaaaacgacgagcgaaattgaaaacgcgcgagtgattggaagcgcggagggagttgcagagtgaggggtgagggaacgtacgtcaatgggagcaggagtcatgacagtcatggcgattgcacaattgacctcgcgtggcgttgcttatggagaagcaatggaagagagagaaagaggagagagaaagggggaagagatcactgtgagaaaacgagatcaccagaagctattgctgtgttgctattgctcgagacaagagggagaaatgtccttggtttttatttggggctttgggcattctcggtatttcacctctcatatttctgtgccgaatttctatatattcaataactagggaaaaaataaaaataatagcatggtcataaatgtggaattttttacggtttcttacatggatgtgtctctaaaccaacaacaggtatcgtggtagttaccttttgtatttttattaaagtgatttaggatttcagattttttatacgaaacaaattgtgggagaagaagaagaatacacacattatgtgtttttataatttccaacgaaaaaaaaaaatgtttcttctcttaatgtatatttgtttctaatcctaataattaattggccatttgattttttttcttgacttaatgtctttacttagataaaaacaaaataagaaaaagtttacaaatttaaaaaatcaattaaaaagaataaggactacatttatgttaatcctaataggtaacaaatcctaattaattgtgtatttaaattttttcaagatttaaatttctttacttagataagaataaaatatgaaaagtttccaaatgtaaaaagttgattgcgaaagaatcaggactacatgaattgttgaaaaaattatttataatttaccatattcgattataaaatatcatattatatatcgtacaagtacaattatattgtatataatacgttaaaatgttacttttatctctataatttattcattttcatttcctataaaaataagataaaaggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgataacataaaaaaaactataattacatagtgtcatgtcaatgaggaaaaaaaataaaaatatatatattttagataaactaaaagcaaaataataacacatttacatgtctaaaaaatttaaaatcttaaaatagatattaatataagataaatagttaggtatatatttttggaattataaaagttcatctttgttatttttttgttataagctcatttttaagatttggcttgtttgaagatctagcttattctaaaaggtgttacattaacatgaattaaaatatgttttacaaaaccagaatgctaaatcatagttgtaatgataaagaaatcttattttaaagattttgtttggctaagagcccattttaatgacttgtcctgatcaaagactttgtgatggttgcaccataatttgttgtttttacaaatttttactatagagttaatccataatgtaatcctaaaaccatatttacaccaccatctatgactatcactcaaaaaatcatagtgccaagacaatattgcccttcattgagacatgtctgactaaaatatgtcatcgaattgtttaaaaagttcaagagctaagcctcgttagcatttgtcatgagctgataatttaggctttgtttgctcattttcaaagtttatcttagtttattagacaatctattaaggattaaaccttcaaatagaaagtcacataattagacttccaagctagccaaaccttcaaacaaaataggccaagccttgatgaaaacttaaatccattttttgccctataaatatgtcccttttttttgtttagctcctataaattgtattatatttttgtagttcttataaataatttttttagtccttgaaaattatttttttttgtttttagtcattgtaacttttttaagtgttttctgacgtggcatccaaagcattacatttttctgctaacatgcagcttattaacgttatcacttgttgatgtaacactccgattaaactcacaccagaatgagggagatctagaggttgtgcaagatggaactgtattgttgatgattacttaaaagaattacttatactaaaaaaatgcatctagtccatcacttaagaatttcatcgtaacgtgtgtttgactttgataaattttgggatgggagatcctagaatttttttgtaaagtgtttgagtaagatcaaaatacgttgaaaagtctcgtgttagtttgcgggaaacattcaatgattttgaaagcaattaattgttacaaatgttgttagagttggttgtcgagcttcaaagaaggttacttacgaatgattttgaagtataaagggttataactaatgagaaagctaagtaaagtgttggagagtgggtcatcgagatgtcagctcccaagggcattacaaatggtattagagcatacttctctacctgtatagtgtgctttgacgaaccaaacgaaagctggttgacatgtaacactttaggcgaagaatactaaaatgagttagatctagatattgtgcaaatatgagattgtattgctgaaaacaacttaaagaaatcaatcactactatctataccaacaagatgcatatattttttagtagctcatccattaagaattttacaatttagcatacttgactttggacaatttaagtttctcagaaaacgtgcgaatgatgacaaagtatattgaaaattttaatgttgatttgtgatggtagtcaatgaccatgaaaaacaattaactgttacgaatggtgtccaagcttattgttgatgcctcataaacaataaagaaactaaatgtaaaaaaacaaaataacatattccagttacctctttaaaaacatattccaattacctctttaaaaaatcttaggaactaaaaaaatgagaaaattataggtaaaggaagtacatataaccttaaatataaagaaaaaaaaatgagaaacactttttgcctctttatattttcgtataaaataagttgaaagagagaatagaagttaaaaagaaattaggagatagtagttttgaaaacaattaaaaaggtgtaatagtcaaataaaagtacaaacaaaaataaattatttaaagaaatgtcatctttacataacggtatagatatatataaattcatatgtctatatatataaactaaaataattatcttaaacaaaaagattttgtaaaattattcttaaactataatattttgaagtgtttttctttttaacaaaagtgtttttaggaattgttattaactatcactttcattgattagtgagacatatatgtttgatcctaatctcataaattgattatttattttattttttatttttcattcctttcaaatcattttatttactaataacttatgagtcttaatataattaggctcaacggatctcttaattagagttttggatttaaatatcataaactaagaaacttaattaggaagagaaatctaactaaagtgataaacgatgtttcccaacgaagatactaaaaatatacagaaattatattttatattttactatacacacacaattaaagacactctgtatgtccaaattcttacagattatgtattttggcttcgtttttttcgctgtaaatcgatgtgtagagaaaagcatgatttttttcggttgattaatccctaagaaaaaatttgtgtttactgtctaaaaatttatgactaacaaactattttctttttgtgcaacacagggaacttcttttttgcttcttacggtgtcgtaactttttataatgcttgcaaaaacgttttggcatttctttggtcttgcacccgctgctaggtcttttttattacctcctttgcttttaatttaaagtgtaataattgcccccataagacgttatgaaaagggatgacaaagtgagatagtatataagaaacgggtcgatctgcccaaaaaatataggatagattgacttgactcatttgaactaataatattagtttatcttattttttaagaggttaaatatactgttccgtcaaattaaatctattttgtcataagatccgtggatgataaaatggatgaacctattaaaaatggactgcaggaccttagtccacacaaaaaaatgtagacctattttgtaaaataaattaataatattaatttatctcattttttaacaagttaaatgaattaacccatcgaaccaaacttatcttatcatttatatcttatatatgtagtatgaaacttgttgaacttttgatttaaagccaaaatttgtaccaaacaagatattggacatttatttttatgaagaaaataatttaatttttgttaaacataaataaattatttatcaaactttattttatacaataatttaactacgtaatatatttttttacctataactaattgttgatcacttcaattactaaatttgtgtttatccaatttattgacaagctttgaaacaaatcaaacaatgtttatgtcacagctttctaaattaactccactattagattatgttaagacgtacaccaaagtaaaaacatacacactctaatctaaaatgatttattattattattattatataaaatcttacatcagctctcaaatttggataaaagttgagggttattttagattttctgtaattaatatcaaacttatcaatatactaaacaagaatcatttgtgatagattttgtatgatttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagtctctaaatttaataatttattgacattttgatttctgaaattaattacatattatcattttgatccctaaatataatttaaaatttttaattaagtctcacattatatataaattattagcataatcattatcatatccttattttcattttatatccctcatatttttcacatttcccttactcattctatatttcatcttaatttttacatctaccatttgaatgtaaaggtcgtcattcatttattcaattgagacataatttttaataaataaataatataaaaaacatctttgaaaactttgaattttctcttgataaacattttctagttttcttaaaaaattatattttattcaattaaaaatttcaattaattttgtcaacactctcaatattacatttaaaattattttatgtgtatatataactggtgataatagttcataataaaaataacttttattatttacatgatatgcatgattctttcattttgatagtcgataatttactaatttattacatggatctatgtcattcctcccacttatgcctcctcttaccaagtaaataacacaagtgacattttttccatgacaattaggtttagaggtctgagataaacacaaacatttgagtcaaggaaaaacatttaaccgtaaaatgaatttatcatatatatttgaattttcatcacactatccgtctcacattttcacatatgaaaatggatacttagagcatttttagtgatagatcttaagcaaagatcttaagttcaagatctgatcttcacaagatcttccaataaagtaagtggagagatctccaacataaagaataggttcttgtacaagatccctcaagatttgcacattgttcaaaaaagaataaattttctctttctttctctctccctaagatctcaaaatgagatctaccattaaagtaaaaaattagagagatctttaatcctatataatactataggatccactaaaaaatggtctaaaatctcaatttaaaatctaccactaaacatatttttaaaaaaagtgtcaaataatatgtcagaaatcagatgtctaactctctctgcaattctgcatcttatagactgtacttcgaagtttgaagcgtgaacacctgaaaggctgaaacaacaccatcatggcgtttcccaaaacccgtcagagccactcctccgccgcttctgctccctcccaccgccgtcacctcgcgacgaaagcgacgccgaactggtcacgaagcccttccacgccactgagtcaagcctccagctccacggcatcaccctcacccccaccctcctccgcctcaaaaaccactccaagatcgccctctccctcttccactacgccaaaaccctccccaaccccctctctcccactcctcctacaccctcctcctcgacaccatttcctaaccctctttcgccgcctcatctgcgccggcctcacgcgccaagccgtacacgccttccacgacatcgacgcgacgccttctcagaaaccaaaacgacgcccgaagacttctgcgtcttgctcgatacgtactgcaagtacggccacgtcagactcgccgtcgaggttttcatcaaaaacaaacacacagtcccccccaccgtgaaaatctacaccgttttgatctacggatggtgcaagtttgggaacgttaaaatggcgcaaacatttctaaaagacatgattgatagaggaatcgaacctaatgtttttacttataacgttttgttgaatggagtttgttggaaggtgagtctgcacccggaggagaggtttgagagaactataagaaatgcagaggaggtatttgatcaaatgcgtgagagcgggattgagcctgacgtgactagcttttcgatcttgcttcatgtttatagccgcagctcgtgctggataagctgaggttgatgaaggagaaagggatatgtcccaatgtggtgatgtacacttcggtaatcaagtgtctcgcctcgtgcgggtggcttgaggatgctgaggttgcttgaggagatggtgagggatgaggtgagtccgtgtgccgcgacgtataattgcttcttcaaggagtttagagggaggaaggatggggagagtgcgtagagaatgtttaagaggatgaaggaggatggattgtgcgcaccgagttcgcgcatacgtatgtgatattgattaggatgtttttgaggttggacatgatcaaggttgtgaaggagatatgggaggatatgaaggagactggggcggggtcggatttggacttgtatacggttttgatacatgggttgtgtgagaagcagaaatggagggaggcttgccattattttgttgagatgatagagaatgggtttcttcctctgaaacctttacagggggctgattcaggctgatatgttgagaacttggaggaggttgaagaagaagcttgatgaggaatcgatcacgtttggttcagagtttcagaattatcaattgaagccatacaggagatacgctacattattacacataattctgctataggctatttcaaagctaccagattccagaaagagatatctaagtgggatgtataggtctgcacctcatgatatgggtaaagcttgtgaaaaaaaaaaggttcttacggaagaaagtggaattacaagttacaattctacagaattacagaaatcaaaacatagtggttggatgacagagcattctggagaattctctcctttgaagtcctaaaagaacagttggagggctctggtaacacccatctattgaaatttgaaagtactaaagttcattcttttactagtggaagttatactacaagttctaggacgaggagggttcacaatggaacccctaattcaggaggatcagccaaggcttttcatcataggttcacaacatctagatttgacaactctggtagggatggattggggaagttacaactggtggtagctttcttgattatactatatccgtaaaccaatataatcaccttcattttgaagttcttaaatttatattcattctcttcttttcttttattctttctatacattgtagtgacaaatctatcagcactatcggtctttgaatttggtggggagggggagggggatgtaactgcaccccgaacttcctcttcttgtttgtcttatcatccaagttacgtgttatatttaatgttttaaccaaatgaatgacgctaatgtgcctagacttgagcctttggacctgtgcatgcaaagtctcttattgtccgcattatttggttttattgatatgtattttacataggccaaaatgagacgacatatgtttagatactagatactggaaaatggaaatgatgtgatttcctgcaagtctgtttttttttgggggggctctatgccttttgccaattaaattaggagagtgtagttgtgtttgaatgtaagactccttggcaaatttgtaagacgatgaaattctatgattggaagagcatgttatttatctgatcatctgatgagattggagggcatgttatttaagaccatcttatagcatttgctcgaatgaagaaattctttacaatatttttatcgtattttaaattggtcatatggtatgaaaaacttaattataatatttggatgaatgttgacaagattaattttgaatgaaattaagtttgtaaaattgattttggttaaaattgatcttgaagtgatatgatttatgtttgatgtttttattataaaaataagtcaggaatgaattcattataaaattcttgatcaaacttcaaaagttattcaaagttggttcaatttataatcaaatgtataaaaatatgtaaaaatttatttaaaataaattttggatttggattcaattctttaacctacacatatctctacactcacattaagatatttttttcatttaccatattaattgtaattagaggagtttgatgactatccctaattcttgttaggctgttgtataaatcaaatagattgtaaaatatgaagtttataagttaaagaggtcaaattcaagatattttattcttcttgtaattattttaatgaaatttgccattgcttccatattaatgtatggaaagtcaatgtagaaaatctaataaacattaatcaatatatatttttcttcttaaattcacttttggtcccataaatgttaagaatatgcacttttagtctctcaaaataattnnnnnnnnnnnnnnnnnnnnnnnnnnnnnnnnnnacatttatataacatgcatgacaaatgaactaataatctaatatatatgtaaatgtgacactaataatttagtgacattacaacaatgatcacaatttggatgatccatgtcatttagcatatatttacattgttatgttatttataataccaatgtgtcggtattacttcatcacttaaatataacattaattttgtttgttaaaaattcgatggcagattaacaaaaggccaaaattgctaaatttgataaacattgaggataaatgtgtaacaaatttttgaggggccaactatagaatcataaaactatagagggcaaaagtgatttaagtctatctttttttatcattgatgtaagcttatcttttgtaaccataaatatttttcacgagacaaatatattcaagagtatttacagggttattctacttttcttaacaatatgccatacttaataaacatatgatgagttacaactaaacaaaatattataagcaatttcatataaatctaaaaataatttcacaaagattgttttgcccttttgttgttcgatttacttaaagatcttatcatgagattgattgcgatgagatgatgcttttggtttttgaacccagggtaggtcttacaagattcatttctaggtctatattatatcgtagaacatctttagtggtagattctaaattggaatcttagaccactttttggtagatcccacagtatcacataagattgaagatctctttcattttttgtcgtcagtgatagatctcattttaagatcttagataaattttaatggatcccacatggatcccacaatgccacttttttttcctcctcctcaatgttcacttttctttttttctctcctctcttcaagccaccttttcttcttccttcttcgcgttcttacttcattccgatggatctgtgttttattgttactactattgatgaataattttttaaaaatctgtataaattttaagagtttttgtgatagaactaaatctgcagtttcctgagaaacttcccaggaggtcacccatcccaagattgctccaagtcaagcacgcttaactgtggagttcttatgttatgggctaccgaaaagtagatgcaccttgttggtataggtagtacctattaaatcctttaagttatcctcaactgtacagtcccatacctgcacagcctctggatccctctcgttcgggtgtgtattcgattcattcatgtacccctcccgctggaagcctgccaggagccgctccttgtccgtgcctcactgcaccggcgatcactccccgccctcgtcagcgcccgagatgttacaatagcagtcaccacccacacatgatgtcacaatacctgattttggctatcaattaatgctttaacctattcaattattcttgcttctttctatgtgaatttcaacctttttttctttcattaaagtcacttctagttgtatatatcacgaaatgagaaacctttcactttctcacttaattaattgcacccatctattttcactatgaaaatgtaggatcctcaaagaaattcaaagcaccattttcatctcaaaagcaaataggtaacaaaaaaaactatcatcattcatcacaataatacctcactagatttaaaaagcacaaatctcacatcacattcgaacacacactaaatccaaatcatataatatgtttgcaccccttttttcatccccttccttttaacttctcacgtactcgtgtcccaaaatttttacccatagaaatttttctgaacaaaaacaacccacaacaatttcaaaataacacacccaaaaagaaaaaagcagtctttattactctcttcagttattgcagtcatgccttccttctttcacaggtccaatattcattcttccttcccaagcatttgattcttccaccactttcccaaacaacaaaaccctagattttctctttccaatcacttaattctctgagttcttcacccaaaaggcaaaaaatactcaaagtcccccctttttatttttcatttcaatcacatccccttctcaattctctgattacctgatttattcaactgcttctgccgtttcccctttgcataaaccccaatttcttcacgtggatctctgaaattttttcaccttttcctctctgatcacgaatgggtatggcctagttatactcaacattttatttttatcaaataaaaggaaccgttttttttgccctgaatgagttgatttttttggggtagtttttgttgttagtgtatgttgggttgagatttgagaagcatttttctttgttgccaaacagtttgcagttacagcaacaatgtcagatgacatgctcattcatttctcatccaactcatccaaccaatcagatcagtctctgcctacaaagattgcaaaattggaagctcgcatggttggtaagggttcctccaccactgctcagcaatcaggttggtcctctgtgtttgttccttctgttgggaaatttggcggagctgctgaaaatttggctgaaccatccacttccagtgattctgatgatgatgtaagtcttattatccctatatagtgcaatgtgtgtgggaatttgactgcatttatgaggactattgttgttatggttttggcttatttgcttaaggttttaaatatcggtgacaatcatggtcgcattgtggtttcgtcgttattgttgacatcatggcaaattgtggacaaatgtggccgatgcggtcccaattgtggtcgtgttgcagtcacagccttgatgttgcggcccaaatcacgactgtggaccattttttaataccaacgcttgtgttgccagggattgtcaatgttaatatagaagcttctcttgttgtttgttttggtggttgattgattgtgtatttatctatggtttaggatataataaatgtaggtggtatgttttgtgttcattgctgctgtttttatgatggtgacttgacatgaagattatcggtgttgtgtgtttattaatgatctggaatattggtagatgtatggaaatatattcctgtgataacttgactgattagattgttggtatctttttatttctgttctagaatggtggggaattcttaatacaagccaacactcagaaacgccaaaaacttcaagaagatggcagcacaagtgtttttgaacgtgttgaggttggttttcatgactccatatactctttgctatagttgctgatcaaaaaaaaaaaaaatatactctttgctatagttatagaatagctgcatctcatgttgaaatttgtaaaaacagctactcactggataagttgcttaattttaaaggtctcgcccttatcatctatttctattattctgatgacttcattaacaactagtaagaagtgtactttttgtctcagaaattggtcgtctagttgtttccaacttaaaatattttgcatatcaggttgttactgatgcaaggcaaactagtttggagaccatggagacaaaaattaatgctgatgtgaatagaaagaaacatggccgtggaagagggagttctggttcaggtagaggccgtggttccagagttactgatcagaccaaaacagaaatttctcctccaacagttttggcttcaaatggtcagattgagaatgtatacaaggtatgctccctcccatgaaatatttgttaatggaattgtaatttgtcaattgtccctatcagttttttttctttctaaactggtcttttcaattgtgtttatatatctgtagtcaatacctgattggatgcatagttgcacaaccatgtcttctttaactgtttttaatggagacctgaaatttaaacttcttggcttaaagaattaactgctggaaggaatgattatatccatccatagctgataggaaatttgttgcactgatcttggtgcccgtttttgctgcttggtatttttgaatggttactcaatatcagtgtaatgtcttttaattttttaaatcattctctgtatttggcaaggtctatttgatgttattgtctggttgcgtcttttagctcttggttatgcaaattggaatctttcctgattcctatgaatttctattcataagctcaagaacgttatattgcttaagcaattaattttacagattgatcatttatattgtactccttgattgttccctatagagctcatatttatttgcaggatggcagactcagtgatcagtttcatagtgataattctgcttcattagaggtgcggatttggcctaattccacttgtaaattttatggtcattaaaagaatatgtggctttgtatgaaaataattagaagtttgatattacttttttcatttctacctccctccaacagatcccaatgacattgttgatactttaactatttattgttgtttgtaattttttttaaaaaaatttcattatttcatctctatattcaattaggaggacgttgcatctttacaagcaaaagttgttgcattggaggaggaattgcgtaaatcaaagcaagagaccgctgattatcaaaatctttatcgacagttagaaaaggtatatgtataataataccaaatgctaaactctcaattgtgaatcagaaggatgttttctgaatcttgattttggcatatgcaggaactgaaggagctgaatgatcatgaacagcaaatgaagcctaaggtgtgattattttcagtttttgattgctcggtagttgtaattaaagtttcctttttgaatctatcaaaatatttcactcctcattatgtacatgtttaaaatagatattactggctgtcttaaattttgtttgtttgaattctatatgcaaaagtgaactggaaatcttagacagctccttgttgatacaagtgtgccactgccagggtcccgctcttctaaagtgagcttcttattttagagagtaaaataagcaatatcagtcgttgatattacatgcacatgcatgtgttggaatattaaagtattaaacattgattttctcatcaacgattgatgctactttacctatactcaatttagaagagccctctgctaccactccctcccctcccccaactaaatggttaataagcattctttgtaccatgcatcaattaagcagcagcatattaacatttgatccttctgttttgcagagaatgaaaataatatctgacttactgatatctgtttcaaaggctgagagacaagaagcaaggttgaaagtacggcaagactcattgagacttggaaatgttggtgtaatcaggtatgcatggatcattttaagaaatttcttaaatctcagatagcagagtagctgaccccaaaaccactctagtgggataccagatagtgggatgacttctactgtgaaattttagttacaagttcaataacttatatatagacttatataaattacccaaaattagagacattcatatgctggcaataaagaacagagaactggattaaatcatgaaagacctgtgcaagagtgtttactgcaagaaaatgaaagggcaaaacaatctttaagagagagcagagagcagtgagagagtgaactgaacagagcaaggctggaaacaccaagaaggtgcacctgagagagtgccaaagaatagtgggtcatgtttcagagacacaaggacacaattgttttagaatagggtttcgatttcgaaccccaaataagagaagcaaaatcatgaaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccacaaaaaaaataaccttaaaaaagttgtggggatacacaatggcttccaaccattaatcaaagttgcgcccactaattccatgaatagccgcaaatgctccacatgtgacagtgatctgcgacaccacaggcttcaacagagcggccagtagctgcgatgcaatgcaactgtgctatagaacacgattgaaaactgagaaattatatttaatatcattttttttaatttcttattagttcaattatgaattgtagagctggaactgtcatatccgagacctgggaagatggtcaagctttaaaggatctgaatgcccagcttgtacgttccatttcctttctcctccatgattttttctttttaatttttgtactggagattattactgattgtgatcgatttatcagattcaacaaggatttattgtgagatttattctgatttaggaattattataacagactatttttaggattctgattctttccttatttaatgtgataaatattatccaaattgattttttcggatttaacatttcatagttcaatataattaaactgtcattatctgaagacattttcatgttttatttgtgcagtgaaataacatgcttttcactatccttcttagattataaatattattaaacctgaacctttttgcttcagttggacagatgactgaatacaattataggatagtagtgtttttggagtttcaagggttttccttctcagtaatatttggttgtagcacagggtatataatgtcaatgttaccataacttctgtctgttagttttttgcaattgaaaccttgcctatgttgatagtttgcatagtgatgtcatgaattacttttcctcatcattctttgtttttccccagaaacaactaatagaaacgaaggaggcaatcgagcggcagcgcaaattatttaagaaaaaacaatctggtaaattctgtttccttttttcttttagcacttatcacctaaaattggggaagaggggttgatgggaccaaatttgggactgtccttttcacttctccattatgccagttgttggtatgaacattccatacatcttgctaaatttctacattgagtactttgtatacattgactttcaatagctttactagatatgtactaatcatgaccaaccatatgctccttaagatggcctaatggatatctggatactatcaatatctgtttcacgctattggatactgctagactatcttgtaatatattactctggtccatgtgttaatagtgtgtgttttgtttttgtttggtccttttctctgattgaagataagagtgatggaacagatgcagaggctggattaccagaagatattctaattcatgatgagatctacaagtctcgattagctagccttaaaagagtaagttgatatttctgctggtccgattgtttctttcctctttatgtttctgatagcaggaaaatgttcaggaagaagaaattattttgcgggagagggaacgatatgaaatagagaaggggaggttaattcgtgaaatgaaacgtatacgggatgaagatggttcacggtttaacaactttcagattctaaatcatcgctatgcccttcttaaccttcttggaaagggaggattcagtgaggtgtacaaggtcagatcagaactatcaaaaagtataataataatcatttgatcatattgatattattttagcaagagaaatgccaacaacatactctagcacacttttataaattatttattatttgctgaaaattattagaactcacaaaattgtgcatcaatatttaacatattcccgctaatgattttaaagtttccaataaatttaactaataaattaataatagaaagtatgttgctagcactcctcttttagcaaatattatacaaggttttgagaaactaaagccagaatctagacaattacttggcctatgttggcaattgtaaataaatacctttttgcagtgatttgaagtaagaaatttccagcaggctttcgacttggtagagcatagatatgttgcatgcaagcttcatggtttaaatgctcaatggagtgaagagaagaagcaaagctacatacgccatgcaattcgggagtataatattcacaagactcttgtacatcgtcatattgttcgtttatgggacatttttgagattgatcaaaacacattctgcaccgttctagagcattgtagtggtatgtactgttgattcaccgttttcttttgatttagtattttagtgtttttccaacccatttgccctttgacactcttttattcttcttctagggaaggatcttgatgctgtcctcaaagcaacacctgtattacctgaaagggaggctaaggtcatcatggttcaaatttttcaaggccttatttacatgaataaaagaacacagaagattatccattatgatttgaagcctggaaatgttctgtttgatgagcttggtgttgccaaagtgactgattttggtcttagtaagatagtggaggatgatgtgggatcccaaggtatggaacttacatcccagggagctggaacatattggtaagtggtaaaaatctttgttggaatccaaaatttgaagtggtccaagtttgtatgattaaagcttcactctcctcaatctgacttaacctttgaagctccttttaatgtttccttgagattccaatatttaatttcgtaaaatatcttatgcattcttcttttcctttttcaatttgcaggtatttacctcctgaatgctttgagctcaacaagacacctcttatatcatcaaaggtcaataaatttctaagttgtaaagacaaggataaatttattttattattgttattgttattattctcactcacaatcactttggtccaaaggatatttcactttgatgcaagtgtcacaatggttgggattgcaaacaactaactcttggatcatcaccttaacatattttgtcatttggctcttgtattttctaacactttgtggaaaacaggttgatgtctggtctgctggaattttgtattatcaaatgctcttcggccgacgtccttttgggcacgaccaaacacaagagagaatacttcgcgaagacacaattattaaggcacgcaaagttgaatttccttctagacctaccatttctaacgaggcaaaggtgagttgcacccttttctgataattgctgctcatggctgattgttctttggccttatttcataattttgtttatttacatttgggtgttgttaatgaaccccctaagtgcattgatcgaggaaccaaaaaataaaaagttttttggaaatcacactgaggtgcactagaaatcatggtagacgtgtattaataatatttttaataaaaactttcctcttttgatttcttagtcagtgcatttgcctttattttattctgattttcagtgatgtacacaactatgctttcttgtaaggttatatttatggtaattttcaaaaaagaactatccaactttattccatatgcaagtgtaggaaggtggttgtttccattaaagacctcaaatatatacatacttatatctggttaatagtttctatgtttagctgtagaaagaaaatagtacctactatctacaatactgtcaaagtcaaacctgacaattgtctgtgctgtatctacaattaatttggtcaggattttattcgacggtgtctaacatataaccaggccaagagaccagatgtattgaccattgctcaagacccatatctcactttctcaaaaaagtaatggcattcatttacatggcttcattatccagactccacggagaaagaatggaggatctcatcttctaacttcagttactgaatctgttaaattttgtataggttgtaaagatttaatcttgtcaatgaggcagagagggggatttccccattctgaaaccgagtccagttaatttacatgcatcaccttttggttcaaaatatgggggagcaaatggcatgtgggtttgatttgacctcaaaaagggtcaggaagtatagttactcactcgcaagtgaaaaagcttgtgttatttttttaatactcttgctcccaaatataggattttaatgcattttgattggctactttatcttcttttttttttttcccaccaagctattaacttgtggagggagatttattttaaggatgtttgaaaggtttgttttacatttggctgccgaaatcgtatatggtgtgttactaacccaaagaaaactaataaatatgtggggggcatcatgaaaagtcagatagcttttttaggatatgatttctgagttaatgaaacgaaatataaaaatatattatgattgaaattagttattggagctgggagcacgcgtgcgacgccatcgcttggttctgggaggcacggcttgtgaaggggttgatggaaggaaaggaggtgaattggtggatggagagtgaacggttgaaagtacttgattagaagaatctggtagaaaggtagttcaaggagtttgagtctgccatggagtatttatccaagtatttaaagagtgtgatgatggatggtgtccgaaacaagtatttcggaagtatatatatatatatatatatatatatatatatatatatatatatatatatatatatatatatatatatatatatatatgtaacccaaaaacatatttcaaaatatctgttctgaaatatgaaacggaacaagtattccataataagttttcaggttgtctatatacttttaaaatagataattcagaaacttatttaggaatacctattccagaatacaattttgatattctaaaataggtattttagaataggttttgggaatatctataactttttgaaatggccatccggtaacaaaggaaggataattggggaatttaaaaacatctgagggtgcaagaagcaaaaaaaatggagtgcaagaaacaattgcctctagagcatgaggcctaatgttcagcaagaacgaatcgcggtaaatatcacagttgataatagttctcattaagacctaacagaaattagaatggaagttgtggtgttatgaataattccttgaagtaacattgagagacaactggatccattaatatcttaatttggatagatttctcgataaacacttaaataaaataaaataaaccaaagtatagtataaaaaaggtcctgcatatattaaggaatagataatataggagatgtaaaattgttttgataaaaaaataaatacatatactaatactataaaagtttttctacggttattaaatgagaaatcataatatacggtatgtttattaatttgataattatttttaattctttgatttattttttaaattcaatttgatcctcttattatttaaaggttcaaataagttctatactttaaaaaacaattcaattaagtctctttttttaaatattcaattagttcctttatttttttaaaacaaaatcaatttaatcccattttttccatctaatccgaaaattttaaaaataagaccaaaattggtgaccaaaacatatatgtttatgttagacaaatacttgtgtacttaatgttgccccaagtttactgcaatatatgcagtcgaatggcaatgggcaaagctgacaactgaaaagatcacctcaatttagttgttaactaccaaattggcaaataatttcatagatattaaccaaacgaagataatcaattgtattttatttatttatttggatctttgttcaagtattcccaaagacataccaatgaaaataattcctcaagtcaggtactaattaggtaaaatttgctctgcgatgacttatgattcaaaacattaccattgcaagtaaaatcctttcagattaagggtataaataggtacatacatatcatcagcaaatctaaattatcaaatccaactcaaaccgtttgaattggataatcaacctattaacctattaatttgtattaaattattattattattaatatatgtaatatataatatatatttttatatttttaaaaaataaaatgttttttaactattaattacatacacttatcgacgtgaattgaataaatattgacgcattcttaaccttcaagatcaaaacaacaataattatattgattaaaatcattttagatagacttctaaaaatattttgaatctatttacaaataatagaccttataatatcccattgattttggtaaaaagacatgtttaaaactcatcttcactatatttattgaaactctttatttcaaatataatatgcttaatttccattcccatacataaataaatagataggaaccactaaaggggaatgaggtgttatatcatcacaatttttttaataaattttttaacaagaaaaagttgtatctgattcttttaataaaaattcaacttataaaaaatactgtttaaaataagaacatacaaaattagatgtgttgacccattgattcatctcaattcaaattgtttacaaacagattggtttggattgagtttcacttttttcttaaaaatgcaacccaaaccaatctatttaaatttaattgggttgaatcatgaatttgaacaaattcaatccaaacggactcacttatacccctaattaagatcataaatatcataatctatttccaccgtgaccaacggctatagggtatccgtaggtaaaaatacgatagccagcaaaatagaacagtataaaattcaacaagcaactaatctcgatacactttccccttccatgtcagcatggattaaaacttgcttttctctccactcaacagaagcagtaaagtcaaggagctcttctaaaaacacctatttgtaactctgcgtgtatatatatatatatatatatatatatatatataaaaaaaaaatggacctaactgcctgtttctgttgccatttttcgtttatgtgacctcttccttttcctacttctcttcactgtgttgtcttcattcgtttcctgcataagaaccgcaattaataaacatctaacaaatatttaggaaacaaagtttattttcagaggattgtaaaattaaataaaatatataacaccgtcgctgaaaaaacataaattttactaaccctaccttcaaaggaccaatattttgtttttcacttttcttcttcttgcatgaaagtgggttcggaccctgcaaagtttaaaagcagtatcatacaaatatgagaattctaaatggaaatcataagctgcaaaaagtaataaagctttactcaagactaatgtcaaatttaagttcacttgtaaattaactaggacatctttctacacaaaatgcatccaaaactgcacacacacacacattacaaagaaattaattgtttgcataaacgtttcaagtctatataaacaattaaccactgaatatggtaaccaaactcaagctaggaaacagatacagcacaagggtaaattataaccttagctctttttctcttgaactgaggtttatccttgatttccatacgattccttgtagtaatacccttctctactgcctgcacatttatggtctgatcttctgaatcctcaatttcctttatttcagtaatggaattgctggcttcctcaccagtcaatctattcattaccctatccttaaatatctggtactccttctgtgtcatgtgcaatcgtccttcttcagaagttttgacatattgccgctgaaatgcagatggagattcaaggaaaagagcatttctaagaccaaatatgagaggcacaccaggtacctgcaataagcagattaagaagaataaatgtgtgtctaagtgtacaattctacacatcttgcatcattatgaaagcacttcaaattttagacataaagaaccagaagttttcatttttttttccttttaatgggaaaagcaccatactcaatcagaaaatgtcaaaaggagtgcataaaggacacatagtaaggtaattcactaatggtacaaataagaacgctggctgtactgaaaaatgaaacacaaccatttaaaattcataatgtaacaaaccagaaatggaaggaacatgggatagacatcaagacatgaagatgttaaagaattttgtattcaaccactctaacaagaaataactactagaaatgctctacacttccatctagccataatcaaccatgagacaagaagctggatggattatccattgaaagctagcagatgcctcaatcagtaacaccaagttggaagataattcacacatttaggcaaggtgatgcaaccacaatgggatgaataggattagaaatgggaagatgatacaactggattagaatatagaaggtgtttacagacaaaatctatatcaatgaatctgtattaaatagaatgaaagatatgaaatgagagtacgaagatgcaaagataatgcagatgcactaaacaagatactgtctccttgtttccccacaattcaaccataacaactattttaaaaaattgctttaattctggtctaaccagaagttccaatattcaaaacgctagactggacaatacccaaattctccaagattgttatttaactgccaattaaataacaagatcatcaattgcactggtatacatcaatcagtaacccatcttccacagatagcaacatcaaattgatgctccatccaaatccaccacgtctcgctaaccaaggttttgagataaatggctttgctcagttaatgagtttcaacaagctttaggtgttataacagaatgaaaagatacctgtaacaactatctttcagagtatcaatataaatctttttttaaataatcataataagtttgctaccaagaacctaatatcaagacaaatgtattctgagtccaaataggtagaagtgattctttcaggctggatatcattaaaaaaatatagtttgttaattaaacaaattttaccacgattacaaagaaaatatcaaagagaaagacatatctaaccattagaatcaacatttaaaatatatatatatatatatatatatatatattatacatatgtaacaaacctcttgcaactttttccgcaggtcagtgtcctgactagcaacaaagaaatgctcagaatttttttctccaacaacctccatgatgcaagcatctgcgctcttacatttttcatgctcacatctgcaaattggagtaaaatcaaggtaatgatcatttccacagcaataccagcgctcaaatatctcaaaaccctaataaacaaacaacaatgatcctgactagtagtccccttaaagactatcagatgctgattattaggactaaaaatacaacattacttcaaattagtgagccttttaacataacatttcgctcaaaatcataaaaaaaaaacattaaaatattcatgtatgaccagttccgtctgaattttaaatatacaaaatacacactgatcaaagagtatcgaactatcaacaataacaagctatgtactctggttctggttatttgatttggcatcattcatgtatatggtattgaaactagtaaagtttaggaaagaatccatttaacagcatatttacccagcagtaaagtgaattaccttgcaactataagtttatgagctgcctcaagagcctcagaatacgagctaccaagtcgtttcaactcagctagaacacatctgcatcatctccacccaaaccccaaattaacaaagagaaataaaaaacaaaaggtatccaaaacaaaacaaatcacaattcatagttcataccaacgatgttgagctaagaaaaaaatgttaataaatctactttaaacatagagagggggaaaaaaaaggacctcgttgtgtacagcttgaccgtagcactgaggacattgccaatggccgtgtcagcaggggttattcgattcacaagaaggtgatgcacaaatgtgccatcacatagaaccttgtaaggcttccgaaaaccgaagcaagcagtgtaaaacgtcaaaatcttcctgtgcctcttctgctttttcaccttcatctgcaacaatgcataacaacacaatctgatgaaaatgcagaaacaggaattagctcggaaatttaatcggcattagaccattcaactttttcataaacgccaatcatataatctgatttcattcagaaccacaaccaccatattgggtaaaataaaatttcacatatgatagattgatcaatgatggagtaaagaggaagagaaattaacattagtttggcatatactttaaaccgtcgaccacagagtcaaggcagagcagctgtgcgcagcggagacttaaggttagggttgccagtgagaaaaggaacgggggacgaagctgtgccgcctgtacgggggtgcgtaagttaaaacttatcccacactttatgctaggttgatttgattccttaaaattatgatattacacagatcaaaaagaacaatgcacacggaataaatacataaattaaagtatatatttttttcttataaatagttttttttatagttttttatattatttgacgaataatatataaataaataaaataaagtatattaaaatatttattaatcatcttaataaaatttatataattattaaaataaagatagagggattaaaataaataagattttatgttttttttttaataattttgttatttaattattgtttttattattaaatagataaaaatagagatattatatttttttaatgttttatatctgtataattttatgaataacaaaatatagatgtttttttctctttaaattagatatttaatttcatcctcatctatatgatttgtgttattttctaatcctttttcaaatcaaatacgaaacacccataattttaatgaatcaaatgaactcttaatgttattttaattaacttaatattaaatattaatatattattttttaccaaaataatatttctatgttgtgttcttatactatatcttaatttaattttatatttattttagtcatcgagtaaatctaaagtttataaagcctaattgactcattaagtgagtggagttaaaaaggcttttttttttttatttaaaccatcttatttagagtccacagtcgtgttatttgcaagatagttaagtcgattcgttttgcaaactctaacaataacggaagatgattttttttcttcagaattcgagagaagagggagaagacacaagcaatgacaaaaaagtgagaagaaattacaacctcatcgtgaaaggcaataatcgacctcaaaatagatttttcagacgaatgtacacatatctcagttagaaaaagggaaaattcatattaatatgaataccattgggcaggtgcagacagaaacaagaaaattggacctttttcccttttgggggcattttttttttatttaccaattgggggcaagttttaaaaaaattctggattggaagcaagtcgtgccacgtagtacgactccttttttatttaaaaaaataaaaattggacgctaatttcggttgctatttccgtcactaacactttgtggcagaatattgtggttctttttgttttttatatttgcgaccacaatattctgtcgcaaaaagtgttagagacgaaggtagcaacaaaaattagcgatcaaactttagcgaccaatttttattttaaaaataaaagagtcgtgacaggtgacatgacttaatcccaatccgaatttttttgaaaacttgccccaattggtaaataaaaaaaaaattcccccttttaggaaaaaaaccaaaaaattgcatatacccacacccgattgaagataaaatgcaccttttgtcgtttcatattctttctcttactcacccacacacaagtaacattttattatgaaaaggaagcatctctgccagaacatgagggaaaacaagtcttcaatcaaaactagctataacacgatcaagttttttcctctcatgccctccattgtaagtgttttttctccaactgaataagccaccaatggtctccaaatataagagaccacaaaagttcatcatattgcccatcataatggccttcaggacctgtcctgaaaattctttgatccgggacgaagtggaaaaaatgggcccctatcacacattttttttgaaatacaaataatattaaaactaagggatgaaaaaaacggacccttaacacataatttttttgaaatacaaataatattaaaactaagagatggaaaaaatgagtccttaacccacaaattttttgaaatacaaataatattaaaactagggatgaaaaaatgagtctctaacacataaaaaatggatccctaacatacaaattttttgaaatacagataatattaaaactaacgaatggaaaaaatggacccctgacacataaattttttgaaatacaaataatattaaaactaaggaatggaaaaaatggcctctaatacacaaattttttgaaatacaaataatattaaaattaagagatggaaaaaatgggccactaacacataaaatagacccctaatataagttttatttttattttatttttttaataaaaaattttacttaaactaccgacccaaaaaattttgggtcctgggcggaggtcctgctggccctgccccagggccggcctgatggccttaaacacatgaaaaaaactaccctaccacttctgaaggcgacgaagcttttttaaaaccccccaataaaattcattatcgcatcaaaggggcattttgagaagatagtcccaaaaattagctttagcagtaggagcagggtgtaacaccccgtagtactccggttgttacttatcttggtactagagttttcagcggaagacttattaaaatccgttttggaaacatcgtattgaaatcgtggttaaacttttccaaaacattttctcaaatacttttcccaacatgttcacataatacgatactgcaaatgctagatttaaaatcctaataaccccaggcataacttaatacagaaactgaatacttcatacataaaaagttcttaagtagtacatacagatatccacccttaagccggtggcacaacaacacacttagtcttaacataggtacgatccatcaacggattgaccgtactacagtagttctaacgtactgaaatacacgcctaaaacgtcacacgcaagtgagaagatattctaatccgaaacaaccgtagctgctgctccatcacacgcccataggagctttgctagaagagagatcttccctactgactcctcctgaaatgatatcccccaagaaaaaggggtgagacaacccgagtctcagtaagctccaggggcttaaagaagcctctaagtccctgaactcactttcaacacaacagtctatatataaaatgaattgtaaccgatagataatgctaacaggtatattgataaatatacaggcaatagaaacattataattacagttataccaacagatatgcaggcgaaaataacaatacaataaggtaagcaattaaactttctctttggtgattcgatgctccgggacttgaacccaaagtcttactctccacccttctcatcttgccctggtttctctgccaaggacttataatctgtcttatcaaaggtgctttgggacttgaacccaaagtcttatcaaacggtgctctgggacttgaacccacagtcttacccaaggtgctctgggacttgaacccaaagtcttcatatcagtgcatacacatataatcccacacagtgaacgtgaatgaggctgcatgcacacacatatagatatatattccattctcatacatcaatacaccatgatgaaacccatggtggacttcaaagaaagagaggctaaagtaagctccagaagcttacctgtaactccaacgtatgctctagtcaagcttttcactggtccacttctctatgtggccctatagtaggaatcaatcacattattacttgtagaataataagtcaagtatcacacaagacttctttcacttatttattcctacctttcttaatcacaagctctttcttgtctttattatcattattatgccaatatgcaagtcaaaactcttatcttcttactcagttaaagttgtataacttttaatataacttaacaatatcaccgctctaatccaatcctagtttttcttggaattcacttaatgatatttgaacaaaatgatgaaataacactgaccaaccccatagaaatgcctaagtgctgcttagaatacaaggatttcaagctgagaatcaatggctattagttattgagcaccaaggccatggggtctatgaataaacaattctatacctgatgtaatcgattaaaacgcgtgcagcttatagtgtaatcgattactttaacataggatctcaaataaaagcttgtgtaatcgattaaaacgatccgtaatcgattaaaccagagaggtgcttctactcattaagcttgtaatcgattacgcttcgtttgtaatcgattaaaacagtcactcagaaatctgaaatttggattacgcctgttttaatcgattaaaccgatgccgtaatcgattacattgttcataattggttttccagaaatgttatgaacgaattaatcgattacttagtgccgtaatcgattaaaccagacgcatgcttgttttctgcaactatatggctttagatctttggttccagttccaaggcttcaattctaaatgatgaaatgcataaaccatgtctatatgaaggtgtttagaatgcaatccaggcttgggtcaccctagggtgttcaatcttttacattgaacccaaaagaaaacttcatttgttgagccatgcatgcagttttataaaagctttaatgaaccaggattacatggcttcaatttctgagatcctttaacaaacagaagtaaggatgaagtaagagacttacttgtgagtttatgcactcctatatgcagaatcaagagaatgaatgaagaacttgaagaccatgcatgttaactcagacagctttctaagtaaggaggaggattactcttggagtcttagggtaggaatgtgcacgactcagaggctgggagatggtataatgtctgtttccttcaatgaataatgaaattaataagactgggtgcagaccataatggggtaggagtcagctttggacagacatggggacttggaaggagatgctgtctcccacaaggcttggcagtttctttgcaggattccctctgagtttgtgtactgcaggttagtggagtgcctggttacttgtgaggcagactcctgattttcgaaatggcatgctcagtggaagcttggttacttgtgaggcagaaaaaaaaactggaattggtgccccaaggtggaagacaaggctgacccaccatgtgttgccttgagtgcaagatttctacagaccatgaggctatagctgatgggttttaaggctgatctaagtgtagaaatcaatgattacttactcagattttacttgcttaatcacagattattcctattccatcaccataatggaccttactagaatctcaatatagttggcacaagattaggtggtgaggttggaataattattctagtggactcttgtaattttagtcttttgttgctttacacttagagccagaatattgtttccttccaattatctagaccataagtctagaattacaaactttaatcatcacttcttatactttatatcatttcaacttataacatttatactaagagttttacttgacttgcttggcataataagacttcttacacttacataatccttacatatttcatttaatctttgtctcaacactttaattgtgagggtcattatattcaccccaccttttaaaagattttgtcctcaaaatctagacatacctgatatcaaaattgggatacaaccggaggatatcatcctctcgctcccacgtggcatcatcagatgttaaaccttcccattggattttaaccattgggatcacacgacttcttaacttcttctcgtctctagccagaaccttagaaggtcctacaataaatttgagatccttcttgacctcaatctcatcaggctgtactatgtgggagctatctgcaatataccttctaagctgactcacgtggaaaacatcgtgaatcttcgccaagttaggcggtaaagctaactgataggctactggtccgactcttctcataatctgatacggaccgatgaatcgggggctcagttttcgcacccctaaagcacgacctacaccagtggtaggtgacaacctgataaaaacgtgatcaccttcaaagaattctactggtctatgcttcttgtcataatagcttttctgtcggctctgagctttcttcaaccgatctctaatcatatcaatatgtttggtggtctcttccactaaatcaggtccaaaaagttgtctctctccgatctcggtccaacaagtaggtgttctacacctacgaccatataatgcctcatacggagccatgcctaagctagcatgataactgttattataagagaactcaaccaatggcaggtacttatcccatgcatttccctgccctaagacacatgctctcaacatatcttctagcgtctgaattgttctctcagtctgaccgtccgtctgcgggtgataagcagtactcaaccttaactgagtaccaaaagcctcatgcagggcttcccaaaatctggacgtgaactttggatcccgatcactgatgatactgtctggaaccccgtgcagctttacaatctctctaacatacaaacgggctagctgctcagtggtgaacgttgttttaactggaagaaaatgagcggacttagtcagtctgtccacgatgacccatatggagtcatatccgccctgagttctaggcaacgctactacaaaatccatggagatgctactccatttccattcgggtatctcaataggctgcaacaaacccgaaggtttctgatgttctatcttcactttctgacagatcagacatttattcacatactcagctacatctcttttcattccaggccaccagaaattttgctttaaatctttgtacatcttagtggctcctgggtgaatggtatacttgcccatgtgagcctccgacaacactgcctcaaccatatcacccttgggtacaatcaatctattcttatagaatttgactcctgaattatcagtggataggaaatcttgctccttcatttgctgtatcacttcgtcatttacttgggcttctctgattctctccaccagtgaatttatcacctcaactgtggccgtcacgtataacgcctcaggtgaagtcacaggaatttttaaatcccggaatttttcaattagctcatattctgagatcatcaaactagcaacgctcatagtctttctactcaatgcatcggctacgacattggctttccctgggtggtactgtagatcaaagtcataatctttcaagaactccatccatcttctttgcctcatatttaactccttctgatcaaagaggtactttaaactcttatgatcactgtacactgtgaaactggccccatataaatagtgacgccatatttttaaggcaaacactactgctgccagctccagatcgtgggtagggtagtttacctcatgtggcttcaattgtctggaagcataggctaccggcttcttttcttgcatcaacacacaccctaagccaaattttgaagcatcacaataaatctcaaattttccctcgggatcagggagaattaacacgggcgcagtagtcaacatccgtttcaactcctggagactcgcttcacactcaggtgtccacacaaatggtgtacccttacgggtcagtcttgtcaatggcaacaccctttttgagaatccttcaatgaagcgccggtaataaccagccaaacccaagaaacttctgatctccgtgacactcttaggcctctcccattctgtaactgcttctattttgctcggatctacacttactccccgggatgagataacgtgacccaagaactgaatctcaggcaaccagaattcacacttagaaggcttagcatatagcttgtattctctcaacgtctgcaacactgttctcaaatgctctgcatgctcttccttactcttggagtagatcaggatgtcgtcgatgaacactactacaaactgatccaagtagggtttaaagatccggttcatataactcatgaacactgctggggcattggtaagtccaaatggaatcactaaatactcatagtgtccatatctggacctaaaggccgttttagaaacatcttcggattttatccggatttgatggtatccagaacgaagatcgatcttagaaaacaccgtggcccccttaagttgatccagcaaatcatcaatgcggggtaatggatacttatttttcactgtgaccttattcaactgtcggtagtcagtgcataatctactagttccatctttcttcttgacaaaaataaccggtgctccccaaggggacacactaggtctgatgaaattctttcgtaacaactcttctatctgctcttttagttctaccagttctaccggtgacattcgatacggagctaacgatatgggtccaacacccggcaacaagtcaatggtgaattcaatctcccgttctgggggaaactgtggaatctcctcaggaaatacatcctcgaactcacacaccaccggaatattatcactgagctcctttgatgctcctatcaacgcatccaataacaaatatccttctcctacttctttcaaagcctttttcatctttgccatggtcaagcacagattatcatctttctccttctgatcagaaaagtatatccttcggctacaacaatcgatcatgactccattcttgactaaccaatccatgcccagaatgatctgcaagctcatacctcctagcattaccagatcgatctcatactcctcgccttcataaataaactttacgcctttacaacatgaatcagtcgagactttgactcctgtggcagttttcactaccataggaggactgaatttgtctatagtcaggtttaaactaacagcaacaaatcctgatataaaggagtgggtagctcctgagtcaaacaaggcatctatgtcatggcctttaatataaatggtaccttttacaagattaggagacctttcagcctccttcggagtaactgcataaactcgggcactcatctgaacaggatactgctctgctggtgtagaagtggaaaccactggggtagccacatcataagtaggaactgcttgaagtggaacagccggaatcggcgcggcctgtaacattgctgcttgccctactttctgcgggcattgacgcgagtaatggcctggttgtccacaactgtagcacccattttgacccactctacaaataccaaagtgtgtcctcccacacttagcgcagggagaaaccttgtctttgccgttcgccatactaccatttctgaagtttcccttattattccccttgaattggttgtcattcctccttgcttgaagcttcttaccttttccttgcccctgaaagttcttgccactaacatttttatttcccatctctctgcctctcgacctgtaatgctcctggatattcagacaatttctgaccagttcagcaaagtccttagtattctgcccggccagtctatcagcatagaaatcattcaagcctttcctgaacctgaacgccttgtcttcagaggtgaggggagtcctaccataactcgaatacttggcaagcttgttaaatttactcagatattcatccaccgacatgcttccttgtctgagatcttcatactcatgcctcttcctctctctggcctcatcgggaaaatatctggtcacgaactgtccttcaaaagttggccaagtgacaacgtgtccctgactctccaacagaagtttggtgttcttccaccagtcggcggcatctccttgtaacatatagactgcatacagtaacttggtggcatcatcggtttccatgacttcaaatatacgctccatctcttggagccactccagtgcagcaatagggtcccttccacctttaaagggaggtggaatatgctttctgaacgcattgtataacctttctcgggcctctctgttcaccaacagtggttctacaggctcacccacatgctcgacgcgaggaccgccactctgatgagctgcttcctctctctcagcatgggcaccagctgtgccctccggttcgttctcctccatcggaaagcctgacggagggggagctctcaattcagctcgcaacagtcggaacatctcaactgtcgccaaacgattctgggccatcatatcctcattagccttcctcatcctctctagatcctgctctctagactcttggagagtctgttgaaaggcagctagtgcagccgcaataggatcggtcggcgcattgtttgctactcgcctgggtctccctcgtggggccatggtactgcacaactacacaaggtatgagttagctacgctcaatcaagtgacagcacctacaataacatggtccgcaagagatacaaacaaacagatattcatgcgcctatcttagaatcttttcctattcctcgctactcgactctatctaattctagactacagcatcatatcagtgaacattccacgaaactgctctgataccatgaaatgtaacaccccgtagtactccggttgttacttatcttggtactagagttttcagcggaagacttattaaaatccgttttggaaacatcgtattgaaatcgtggttaaatttttccaaaacattttctcaaatacttttcccaacatgttcacataatacgatactgcaaatgctagatttaaaatcctaataaccccaggcataacttaatacagaaactgaatacttcatacataaaaagttcttaagtagtacatacagatatccacccttaagccggtggcacaacaacacacttagtcttaacataggtacgatccatcaacggattgaccgtactacagtagttctaacgtactgaaatacacgcctaaaacgtcacacgcaagtgagaagatattctaatccgaaacaaccgtagctgctgctccatcacacgcccataggagctttgctagaagagagatcttccctactgactcctcctgaaatgatatcccccaagaaaaaggggtgagacaacccgagtctcagtaagctccaggggcttaaagaagcctctaagtccctgaactcactttcaacacaacagtctatatataaaatgaattgtaaccgatagataatgctaacaggtatattgataaatatacaggcaatagaaacattataattacagttataccaacagatatgcaggcgaaaataacaatacaataaggtaagcaattaaactttctctttggtgattcgatgctccgggacttgaacccaaagtcttactctccacccttctcatcttgccctggtttctctgccaaggacttataatctgtcttatcaaaggtgctttgggacttgaacccaaagtcttatcaaacggtgctctgggacttgaacccacagtcttacccaaggtgctctgggacttgaacccaaagtcttcatatcagtgcatacacatataatcccacacagtgaacgtgaatgaggctgcatgcacacacatatagatatatattccattctcatacatcaatacaccatgatgaaacccatggtggacttcaaagaaagagaggctaaagtaagctccagaagcttacctgtaactccaacgtatgctctagtcaagcttttcactggtccacttctctatgtggccctatagtaggaatcaatcacattattacttgtagaataataagtcaagtatcacacaagacttctttcacttatttattcctacctttcttaatcacaagctctttcttgtctttattatcattattatgccaatatgcaagtcaaaactcttatcttcttactcagttaaagttgtataacttttaatataacttaacaatatcaccgctctaatccaatcctagtttttcttggaattcacttaatgatatttgaacaaaatgatgaaataacactgaccaaccccatagaaatgcctaagtgctgcttagaatacaaggatttcaagctgagaatcaatggctattagttattgagcaccaaggccatggggtctatgaataaacaattctatacctgatgtaatcgattaaaacgcgtgcagcttatagtgtaatcgattactttaacataggatctcaaataaaagcttgtgtaatcgattaaaacgatccgtaatcgattaaaccagagaggtgcttctactcattaagcttgtaatcgattacgcttcgtttgtaatcgattaaaacagtcactcagaaatctgaaatttggattacgcctgttttaatcgattaaaccgatgccgtaatcgattacattgttcataattggttttccagaaatgttatgaacgaattaatcgattacttagtgccgtaatcgattaaaccagacgcatgcttgttttctgcaactatatggctttagatctttggttccagttccaaggcttcaattctaaatgatgaaatgcataaaccatgtctatatgaaggtgtttagaatgcaatccaggcttgggtcaccctagggtgttcaatcttttacattgaacccaaaagaaaacttcatttgttgagccatgcatgcagttttataaaagctttaatgaaccaggattacatggcttcaatttctgagatcctttaacaaacagaagtaaggatgaagtaagagacttacttgtgagtttatgcactcctatatgcagaatcaagagaatgaatgaagaacttgaagaccatgcatgttaactcagacagctttctaagtaaggaggaggattactcttggagtcttagggtaggaatgtgcacgactcagaggctgggagatggtataatgtctgtttccttcaatgaataatgaaattaataagactgggtgcagaccataatggggtaggagtcagctttggacagacatggggacttggaaggagatgctgtctcccacaaggcttggcagtttctttgcaggattccctctgagtttgtgtactgcaggttagtggagtgcctggttacttgtgaggcagactcctgattttcgaaatggcatgctcagtggaagcttggttacttgtgaggcagaaaaaaaaactggaattggtgccccaaggtggaagacaaggctgacccaccatgtgttgccttgagtgcaagatttctacagaccatgaggctatagctgatgggttttaaggctgatctaagtgtagaaatcaatgattacttactcagattttacttgcttaatcacagattattcctattccatcaccataatggaccttactagaatctcaatatagttggcacaagattaggtggtgaggttggaataattattctagtggactcttgtaattttagtcttttgttgctttacacttagagccagaatattgtttccttccaattatctagaccataagtctagaattacaaactttaatcatcacttcttatactttatatcatttcaacttataacatttatactaagagttttacttgacttgcttggcataataagacttcttacacttacataatccttacatatttcatttaatctttgtctcaacactttaattgtgagggtcattatacaggggaagcacaaaatgttgagcaattccactccacgttaattttttcaaggaaaaagttattattgcttgcagatgttgatcaacgagattaaaagagatctcatataatggtgaaactatccaaatcacactaaaatgtccatttgctttttgagaggaaaatagctctaaaatccaatgcctcccaattattcttaacacaaaaaagggcgtgagtctcgtagaggaaaaacaaatggaattgtatgtaatttaactatgtccttaacatgaccccaagtggtatgacccacggctccattagctcattgaatatgaaaatcttaagaaatatccatagaaacaaataggagaagacgtgggatcacaatcttgaaacccgtagagaaatcaggggtttgagagtattaatatcctacatatgttgtggatctgtatcattattagtaataagatcatcatgtgtcattgtatattgcacatttgaatctgccttcatattctttgtagacgttgcaccattaccgaatttgaaaaaattatttgactttgtgtgtgccttgaatccaacacttaaaatgattggcctttatatgtagtaaaccctttgggagtgggtctttactgattttggtttttctcactcttatatgatgttaattaatgttttttctttgtgttttaggatcccttctcttactgtttgttgggtccattttttttacgttgcacaaatatccagtcaccatcaaagaatccattacaacattaaccatggaattaactctattgttcccttgtgtggtaccgactggtgtaattgcttcctcgactaaggttttcgacgctagttgcctaggaatgtaatgtactcccaccatagaagaggaattagcatcagcagaagaaggtgaaggaggaatttcctatgatgaaactttgcaatctttggagaaatgtacatagcatcaataattataacatattctgtgcaatccttcatattcaatcttgtataagtggcgttgcagtcacacctaccactgaaacaattaagtcaatctctacacaaacataagcaaacctcccacgtataacatcaatagaattaacataaactttaattggctttctcactccaactactagagcaagtaaaatacattcgttacaaaagaaaagatttaaactaggaaaccttactcgaacaatattttccataatttttacttttgatgaaaaagaaaaaaggagaccatgtttcaactgatagataaccatcaaatatcattcatagttcctcctccttcataactttatttctatccatctcctcatcaaacttgatcataaagaaaccatggtcaacgtccatcaaagcaaaaccaacaatcaacttccatacctaagaaagacgatcattcatgggagtaaatccaatactctttcccaatgatttaataattagtgcatcctgccaaggggagcacagtgctataatttttttattttttgaaactcgtggaattttttccctaatgtctagcgcaaaatcaaacactgatgcgtaaaaaaaaaaaaaacagaaaaatctttttctcaaaactttgccgcgtttattgtaatgttcttttttttcattccctccacgtccgctcgaatcaaatggtactaaaatccaccccccgtagcgcacggcttatccttcgcaccccgaaacccattaaacgaaaaacagaacgctccaacttcaactttgctactccattgtcactgaactttctctgaggtactctctagctactcacatcaactcctgtaaattcttcacatgtttctgcttctctttcatcttcgctctgcaatttcttttttccctctcagtgtttttgaaattcgtttgaaaccctaacactatctacgagattggttttacctggatttcctattctcatacttgattctcagcagaaaacgtgaagaaactcttcatatcccgattttgacctagaaatttcatagctatagtgtgttttctggtttgaaatccaaattgccttgtttattagactgtttttgaaactgaaactgcttagggaatccggttttttcatctctgactttgcaatagctaaagtagcttcctctggatatgctcaattgtatttatttttgaatttttgaattctgttgtgatagtaccttgtcttctgttttacaaatacactattgctgaaacttgagatagcatgtacaatactctgtgttgtgtttctaatgcgttcattcgtacggatttttttttttttgctcttataggtacggttatgatactttcaacatgtacatcaagcaggtaattgcactttggagttatttatttaattaatttaatcttgttaatttctgccgtgtcctaaattattagatctggctagattgcgtttatgtattatgattcataaacactttctctctttcaaacaccatataatatgctgttatttcggttttggattttggagttggttctttgccattttttttaatgtacttgttttgtgtgcttttaggttgtgattgaaggttttaagagttatcgagagcaaattgccactgagcctttcagttctaaagttaattgtgttggtaataattttactgaaaagcttttaaatgctttcttatattgatactggaaaatcctttgaaatgcatgcgcgatgtgggcatttcattcatgacatgttatgatggcagctaaacaaagcatgaaattgaggcaatgaagaataagttgtttagtcaatttttatttgaattcagatatatttgcatagactacatatatatattcttgaaaatcctgccattgatctcctaccataacaccaattaactgcaatatctacattctacacatttccatagagtagtaccctacttatcttttcaaaacctttaaatagctatatataggtccatcatctgaactatgtaggatatgcttgctagtctagtaaagattaatggataactaagaaagtgcttcattaagattgtggttctgagtaaaccatatttattaattctattgattattgttattcaaaatccaaatgaaagactttgccttggaacttgaaagtcaccttttcagttccattaatgtccataaaaagaagggttaaggagacagaagaattttactgtgaaactgaaaatcatggtatgatctcatcctgcttgattgctatgctgataggtttgttctcacatcaagctaaaggctgcatacatttttttttggcagatctgcattctttactcactacattgtcttcagtttcattgcttccttttttccttgttttcactctaatgcattcttcctttctcttaattacatttcatttaatgttaagttgtttctaaagatgaatttcaatcgttttgtttagatcaaatgatgaatgcatctgaattgtatttgtttgtaacttcaaatcttcaataataataatatctattcaattatttatttttgcagttggtgctaatggatctggaaagacaaactttttccatggtaagaaatcaccatatcttcttcgtctcaactttatttactgactgccattagtcttcggaagtaactgaaatcatatctctgaccttcaattggtacaccctttcttttgcagccatccgttttgtgttaagtgatctctttcaaaacctacgcggtgaagataggcaggcactactccatgtatggcacagttcatccatttatttatattctggttctcacctataactaatcagttatagaatttgaatatgcttaaataaattattctctgcataggaaggagctggacatcaggttttatctgcgtttgtggagattgtgtttgataattcagacaatcgtatcccggtaatatgttgaggataataatttttcttctattcgctattcactgttattaaaacgaaatgctatttatccttttttgttcattaagtgtattcctaaatggtgacaaaaatgggacttttttggcacttatctttctcaattctcagtgaaaggatagattgtctaaaagctgttatagggcatatgcacatgaattggattctacaaaacagtcaccttttttgccatttttaatctatggtacctttttgactggtcaatggttgaatatttatccattcttgtgcaatgaatgcatattgtgatcacgctgcttacagaaatgagtttgtaggcaaagaaaagaatataatagcagataaattttgtatttaactgaatgaagacttaatatctagatttgtataatgttttttcctcttttcactcaacgtcatttttaagttgtttgttctctatgttggataaacatcttttcattccatttttgaaagtctttggcattgagattctgatggtgcgaattttctgctagctggtaaataatttgattaatgatgaagtgctttgcattgttttgatttcactgaacttctaccatacaatttcaatttttataaaactattttatgccgaaagcaaaatcttgttattggtgcttgttgatgtaattaataattgcatgtcttcataattgatttctttgtactttctttatgacaacaaaattgctttatgtttgaaaatcacttatgcatgaaattcttaactatgcactatctgtgttggtgaataggttgacaaggaggaagtgcgcttgcgccggactataggtttcaaaaaggatgagtattttctagatggaaagcacataacgtgagtgaaatagaattacatgttagagcatatactttgcatttatttttcacttcaaaaaaaatgtcttattttattgtatgctgtttggttgtatgagtatttaccttgatcctaaagatcatgtacaacctgcagaaaaactgaagtgatgaatttgctggagagtgctgggttctcccgatcaaatccttattatgttgtacaacaaggaaaggtattggctgatggtgacagtgcttgaacttggttttggatttattattgttatatttataaactttgaatctaatatgtaaacctgtttcatttttactattgcatagatagcatcactaaccttgatgaaagactctgaacgacttgacttgctgaaggaaataggtggtactagagtttatgaggagagacgtcgtgaaagtttgaaaataatgcatgaaactggcaagtttatgatttatttatttttaagttcatgatttatctagtatttcctatttatttgttattcatttaagttcattatttgtaatctacatataatactaaagttcttctactaaagttacctcatgatattttctctttaagttcttttaatttattacgtcacttataatttatacttgcaagtcttaaaacaaaaataatatttgaaaaatatttatttaatttagtttttataatttttattaataatacttaaaatttgtttatatttgtatacattgagttaaaaagtgctactaaatacttcatcttgatatggatagggttgaaatacaataaattacactatacgggaaattgaatagtgtgctagtcaaaatataaggcatttttgaaaaggaagatgttgtgataaacaagtttttaagaaccctcgtccagtgactgagactggattgtagtcaaatgatgtataaaacttatttttccgtgaaaattttgtgtgcaaagtgtgtcaataatagactttgaaatactttcattagttaaagaagagcagtaaaaatacttcgttttatatttgttcactcaatctggggtacgtccaattttcctttaccaaccagtaaagggtttcactaataaaacttggttacaacaagtattcttttatgtcatttctagcttacaagtattctcgaggtcactattggtacaacccttagactcccactaaatctaagaacatccaagtagcattgttctgtcactaagtcactcctgactttcacaaacaaaagtttggtatagaatcaaagtcttcacaacacttaatcgagtgagtttctaatccctcactagtactttgtatattacaaagaatggactctcttaagctcagtgtatgtctcaacaaatgattttcttttctcttatttcttatttcttgattcatgattattgtttttctatagacgttcgtcaaggttcttcaatccttgatgttgtatttataggtagagagacgctcgtaattatggagagaatttttgggatttatagaacaattggtgacttattggtcataagttcgaatcttgaaacagcctctttgcatatgcaagggtaagactgagacaatatccctcctccttatcttcgcatagcgaggggcctctgggcaatagggtatgtaattttttatattatatagattattagacctgcaatgttatatagagctaaatgttagccaataaaggcaacatgatcataacatatgggtagcagaaatgaggatgttaaggtgaatgtgtgactattcgaagatgaataagataaaaaatgaagaatttcgactaaaggtagcagtagtactggtgagtaaaaagacgagggaacatagatttaggtggtttggacatgtaatgagacgacctttggatgctcccgtaaaaacaaaagtttgttatcaagagcttgacataaagagaggtagaaatagaccgaaacttatctgaagaaaggtagttaaacaagacttaatggagtgagatatagattgacgaacgatgtgtcttaggacggaatggagaaaaactataagattggtggaaggttagatccattgctatctctatgttcaaaatgattcatttttagtcattttactcttcatctccctttttttttcaaccacctcgtatctatctttggatttatctattatcgaccccaattaacttgggttaaaggtgttgttgtggatattgtgtggttttgtctgataggatcaagacttttcatatctgtcattcataactcaatatgaccgttagacatgtaaaaggaaataaaagatagattaataggtatgttccttttaaacaaaatcatataaactggaataaattgataaattgaattaagcattcttatctcaattggtgtttggatggactggacgagtacttcttgcttacagtagacaaggtgtccattaatggataagtcttcaccttgtgttgcttctagttatcaaacctgttgatttacattaaaataaatattttccttaattttaaatttaaaagttgttaaaaatagttttaagtttatgactagatgagattaagaggaaacttattttcgttcaaattcttacttttaaattttctttgtataaaattgaaattataataagttttttatactgaatagtgtgtactgctaataagtctctctctctctctctatcaataagtataaacaaactttataaacttgattttaatactttaactttatttcaaagatttaaatattaatttctccttctaatatttgcttaatattaatttaatcctctaaatatttgtgctatcaactccatccgatcaagcattaaaaggaattaaaaatattttgatttttaataattagataaaataattatttttttggttatttgggagactaatttgatattgtaaattttttaataactaatttaatatcaagtaaatttttaaggtactaaatagtagtttagtattttgtattttataataatctatttactaatatagtaatatgtatattttaaaaaataacttaatattatctttattagtgaatgattaataacatgaaataaaatattttatatttcataaattcatgcatcacatcagtacagattctagtgtttattattcttgttattgatgttgttattgtcatgcatttttctgttagacaggtaataaaagaaagcaaataatccaagttgtacagtatttagatgaaaggttgaaggaactagatgaggagaaggaggaacttagaaaatatcagcagcttgacaagcaaagaaaatccttggaatatgctatttatagcaaagaagttcaagaagctcagcaaaaacttacagaggttatatgtgataaatgtttctctcttctataattatttgcatgatttcctactgtgttttgttagttggatttacttcttgatgattgggtagttagtcacaatcgttttggtgatgatatattcttttggttcttaaccttgctgtgtggttcaaaatcacagctatatcactggagttaagacaatgaaagtttaaataaattcttatgagtacctcacagatgttttcaattaatattctggtttggtttgattcaattgtctgtgatgtgagtgtactcagttttcatgaaaaacttcaaaagctgtataatataatttgttgaaggacaataagaaacaaaatatgccccccttttgcaatttaatagctaattctagaacacatttaaggtgaaacggtcgtttctctttattttcattccgttttagttgatatccaacactgcataaatcagtagaagttttaaacctttttctgtttagaaattgaaattcctcatgtgctgaaccatattactaaatcacgctcaatagtatcactgttgcactgcgttacccaacagctctccagtgtgctaatcccctctttctctcttctgaccgagtctccattggaccccgtggtccatttgtaatcaactcgatacccttaactcctcttttcttgctataaatgtggataaaaggcctgtcatatactcgatgcaattatttggagtttataattgtacactttaatttctttgttgatcaatcataatattgaatgtcaaatatatattgttcagacatttttaatcccattgttgttatatattgggtttgtgatgcatgaagttgaatgcttatcaccttgttttagattgaagatgcgcggaccaaggtttctgacacatcagcgaggaagtataatgatgttcttgatgcacatgagaaatccaaagatttagagaatacattaaaagatgtatcgaaagaacttcaaaactttaacaaagagaaagaggttattgaaaagcgacgaacagtggcattaaagaagcacacagagcttgagcttgatgtcaaagacttgcaagagaagatctctggaaatacccgagccaaagtactaatttgaagaattcatcttatgagttattttgttggaatggttttgtacatggctcatcttttacctacatgctttcaggaagatgctgctagacaactggagatacttgagagagaaattcaagattcaactgctgaactgggcaaaattattcctttacatgaagatcaagttcagaaagaaaaagacattgccaagcagtaggttatggatatacttgtctttcaatatgcttcaattagtgtactgtatctaactctcccagtttatgtattcaaactttctgacatggtggttacgttttttactgcactcttataactggttaatcgtaattttttagtgtttctcatctagctataaatttggattagtcaggatgtaggatagttatatatatatatatatatatatatatatgtatgtatatgttaatctttcacttgtttgtactgtttttgaaatttattctatcatttgttgaggatattcaacagattctaattagtatttctcccacaataaattaattgttagaataatggagcgtgagaagaaactcagtatactttatcaaaaacaaggacgtgcaacccagttttcaagtaaagcttctcgtgataagtggcttcaaaaggagattgatgatcttgaacgagtgcattcttcaaacaaggggcaggcaagtgttcatttatctgtagagctataatgaattatgtcctaaatactctttgaacagattcatggcatgaagatgtctgcttttctttaatcctgtgttccattaattttaaatgtgataactaaatcatctttctactctgttgtaacttgtatatgcattttttttcatgtttttctgcctaccagatcaagtgcgtgtctaactgggagaaatgatcacttacttttgtcaacttcctaaggtagattttggaaaataaaagtgattatttctgggaaaatagtcattcctaaacattcagagtgttattagaaaatagaatgaaagaagtacaatatcagaggatatggtttcccccatcgaagaaacaaaatgtgtgattgccactacaaacaatatcatctaagcttgtcattctcactgcatttcctattagagagctcataaaatattcttgttgtgtgatgtcgagcaacatgatgagaagacagtttttctatcagaattggcacatactctacttttattcaagttggattatttcctttttatacatttcttcattatctatgcttcatttctaattggcttccttccaaatactctagctcaatttggtcttgctgttgatttgtggaagctgctcgtagaagctaaggtttatgctctaatgaataaatggtataatcatatctcaaaaaaatcgtgagaatgttttggtgttagttgttttaatttttaaaagcaaaaggtggaagccagctaacttgtgattttgaagtctacttctcctatgaaaacaaaaaactgctctctaaaagtactaccaatttttaagagtccgtgagaattttacctgacacttgaatttttttgctcgttctttgaataaggagaaacctgttactaaacaatctcggactcagctgaatggaactttctatgctgcttattttaaaatgaactgggttatatttacattttacttgaatcccatatgttcgtaaagacgtagaccttaactattattaagccatatggtactcaacttgttaacattgatatatgagtattctttgagtatagaactttcatgtgatcattgacccttgccatgagttccaatatttgcaaactgttaatctctgtctttgtattctcctgttataggaacgatggtctcttgtactatgctctcttccttgtttttaattgttgttttggtctgcaggagcaaaagcttttggatgaaattgatcggcttaaagaagaactgcaggattgtgatgagaatataaacagacgtaaatcagaaattactgctttggaatctctcattgctcagtcacgtgaagggcttaatcattacaaagaagagagagacaagttacatggggagagaaagtatgtaactcctcttttgtctcttttttttaaaaaagttctatgtagacttttactagatgaaagaagaaatattgttacagtgaagaatgtgtacaccgaaagtgtaggatggggtgccctccttagcaaaagtagaaaggagaaacatagtaaactgcaaaagtatattatttattactttccctggtcaagaaaatatttcttatgagtttaaattgctacattataggtccctatggggcaaagagaatgaacttacagctgaaattgataagctgagagctgaagttgagaaggctgaaaagagtcttgatcatgcaattcctggtgtaagtaatccctctttctaacttctttaacatctccttttgtaaatgccattaaattgtcaagaatcctcaacatggtgtttctaggcaatgaatctttcactatggacggggtagtctgggcatgtttagtttagaattttattgcaacttatattctacctgatgtgaattaacacaaagtgccatcatatttgtaaatttgtgtcactctaaaagaatgtggatgattttgactatggcctttgagcgtttttacatttttctatgctacatatagatgaaggagattgcagaaacactttaattccagaaattgtattacacttaaaatgatagaagatataaaatgattttgttcggtggtggaagtacttttaatttttgaattggtaaatgagttattatatcataaattaaattgagatagttcttaacacatcctgaattggtaaatacattatcatgaataaatttatgataataatattgatatgatagaagatatgataaatatagaaagaacaaaagtttgttacccaaagttcgactcaaagagaggtagaagtagactgaaacttacctggagaaaggtacttaagcaagacttaatggaataagatctagattgacagacggtgtgcttcggatggaatggagtaaagttataagtttggtggagggttagacccgttgttatctctatgttgcatatggtccttttttagttctttcccttttcatttccccccttctttgcttttacttttttttttaacctcctcgtatctatcattcgattcatctactaccgatcccaattagcttgggttagaggtgttgttgatgttgataatcttaataatttattacattacattactaaaagtgatcatttgttaactttattgaatttgattttatatttgctactcatacaattatatgtatattagattgtgtatgagttttgaaaatcatgctggtcaaaatatgttgtttgaataaagagatgatattttttaagtatacaactttacatgttatgaaatattttcattttttcaatacagactgggtcatacaagtcaattagtgattgactgtgtcgattcgtgactcagtgacctagtagtacctagaccgagtcgatgaccagcccaagtttgataacattgggcacaggtacggagagagagttatgatataataataaattaacaaaaaatgaaatttattgaaactagtaccctggtacggcggtaaagttgtgccttggtgacttattggtcatggatttgaatccggaaatagcctctttgcatatgcaagggtaagactacgtacaatatccttccctcttaccttcacatagcaaggaactagacaatttgatacgtagtttattttttagtagagcttttaatttcttttacgttgcactcaagccccaactccctttatgattgcatgatgtgtattgcaagttgtaactgatactacccaacaagtttcatggattgctgcattggaggtgtatgatcgcctgctccacattggacttgaatgtatataaatttgttattgtggaagtttacggtaatattttataattatatttgtaatcttttataaaaaatctttgaatagtattttaattgaattacagttgtatttttaatcaatatttttttgactatttagttgtagttaattataatgttggtaagggtggggattaaaattattatccaaaatagtatgagtcatggatacttagatcttatgctgctgtttatctgttgagtttgagggttaactgccatgatgtttctataatattattatcattcttgggacaggttgtttttatctatcaccatttttgacactattatgatgttcaggatgtgagaagagggttgaattcagttaggaagatctgcagggagtataacatttctggagttcatggtccaattattgagttgctgaattgtgatgaaaagtttttcaccgctgttgaagttactgcagcaaacaggtcatctctctgatatttcttttaatgtattgatttcatctcatgttgcattgagcatttttttatattgttttgggggaggggcaggagaatttggcacatcggttgttccatcttgttatttttagtctttgttcttggcctgatttcattactggttttatatttttacacatttggcttaatgtttttatttaacatcttttgtttgaacagcttatttcatgtggttgttgaaaatgatgacaagtcaacccagataattagacatcttaattcacagaaaggtggtcgagttacatttattccacttaacagagtaaaggctccacgtatcacttatccacagagttcggatgtcatacctcttttaaagaaattgaattttaaacatgactatactcccgcattcagtcaggttagcttctaaacaaatgttatcttttatttcaaatgggtacaacatctttatgtgctatttggtaataaaataattccgaggttttggtctatcagatatcaacttaacatgaaaaattgatgcataatggagaatcatgttaatttataataatcatgctattaaaggattattatttattgggtagggcttattatcatgtttttatcaaaagtttaaaatcttatcttattttagagatctcccctattcttgagaaacaagaaaaccattattcattgcatttatgactcatgtagacctattacgaataagagcctccgctgtgtaaattagacacagaattcatgtttcttgttttctctcttccttaaaagtttctaaactactgtaacacagcacaaggatctagtgggcaggccttattacctatgaacctgcttcaggttgtttgtactgatcctgattttgcttcaattagactcgtctcttcccgtgttatggattctcactagataaacatcctgttgggatatttactagattcatacactccatctatatagggatgaaaatttgaaattgaaggtattactgtgtaacgtgtatatttcaaaacaaggggggagatctgtgttatgttcaaattcaaatttcgcacaggagttcactagaaaattttcaatgtaaacacagtaattaacagagctgtcaatagtggccggagtggccactatcgcagcagagcgacagtgacgtgtgatgtagacttccttcatgttgcgttttagagttgcggttggagtggctgcgatcgtgcttctgactatgaagcccaagtgaaacccgccatgctggatactctgcgacctcccttgtgccgtcgccgaccacccactcttccattttcgttctctaacagggacgattcattttcacagtggcggcatgagctaacaaagaacatggttagtgatgggtcaggtccttagggttttagccttttagggtgttttttcttcttttttctaatctgttgggcctcgggcctcaagtccaacatttctctgccatataatttcacaagggtgggtttttaacttgttatctggtgatctgttatctttgctataatataataaactaaataataataataataataaaaattataatactattaaaaaaagaaaaaactatttagagcatagcacataatataataaacttaataaagcgtaacatatgataataaattaaaaattgcagtaataaaaaacataatcaactaactaataatcgttataaaactaaataaaacataatatataatataataagctaaatactaataataataaattctgaataataataagaagaaatatatattaaataagatggaaattaataatgaggaatcaactatatgtagaaaatggaaaattttaatttatttttaatgttttagtaaataagatgtttgccgttgatgtgatggcgaatctattatgtctttcgttgatgctttagtttgtgcaaaaggtgggctgagtaaattagacttgtgcttatgagatagacaagacatttcagttgaacacctttatagaaaattattttgtgagattcattgaatgggattttcttagaaggtaatgttgttctgcttctttgtttcaagttggaatcttagatttacatttgcatatgctaatgtagtaaaaataatttggtgatagtagattattaaatattaattctttagttgcatttgatgtcccttaacttgtgatatttcataggtctttgctagaacagttatctgcaagaatttggatgtggcttcaagggttgctcgttctgatggtctggactgcataacgctggatggttggcctagttcttttcattgtctgtctacttgatctgggctggtcttgtgtttttccctgacaaattgtttgacttattacaggtgatcaagtaagcaagaaaggcagtatgactggaggattttatgatcatagacgatcaagattgaggtttatgaatatcattaagcagaatgcagacactattcacattagagaggaggaattggagaaagttagatttaatctacaagatatcctttatgttaataaatgaatattctttttttagttttcatttctcttaggcaaaaactcattataaaatgcatataaaacatgaggaaataaaggaaagaaaatccagatgatctgcttgttggaagaaaatagctccaagagtgaggataaaggaaactttagatgtgttcactttttgttatattgcatatttgatatttcttcgattaattgcaactttacccctctaattttactagtgtgctggctaccttttcttgtttctcggggcatattcttgttgatgccttaaaagaatgttttaaacttttaatgagtaaaggtgcattgcttcataaaattgttttattagaaatgtgtcaagttgaagttaaagataatacgatgttctacctaggttttattgaggataaaacttttgtgttatagcatttgattgttccataatactgaagtccagtggttcttttggactctattatcgagggacttcgttattattttttcttgcatttgtttatttattgatgatgattggttttcctttggatgatttatttgctttatcttatgctaaaagtcttgtaagagactcaatttgttattgatctgacaacatgaaatgtcatatatttctctgtttttgtgaatgacttctttgatgcctaagctattcctccaatggttgttttcactgaattagtcttacagatagaccaaaagattaatgaaattgttgctgaacagcagaagattgatgccaaatgtgctcatgacaaatctgtgattgaacagcttaagcaggatattgctaatgctaataagcagaagctgttgatttctaaagcacttacaaaaaaggtgttattgaatttctcacttatacttaattatccccagggagctacttttggttggtagttgcttgtgaagtttttcactacttttttaataccattttccttaattgcttgtaggagaagtctgttggggatgtccagaatcaaattgaacagcttaatgctagtatcgctatgaagaaagctgagatgggcactgagctcattgatcatttaacaccagaggaaaaaaagcttttgtcagatctgaaccctgaaatcaaagaccttaaagagaagcttgttgcttgcaagactgatcgtattgaggttattcaatcaattgtattggtgctcgtaatcttcataaagttggtgttcttattctggcttaaaattttgcagactgaagcacggagagcagagcttgataccaatctaaccactaaccttaggagaaggaaacaagagttggaggctgtaatatcatctgcggatgcagactctttggttgctgatgctgaatcaaaacggcaggaacttaatgatgctaaaatattggtcgatgatgcaacagggcagcttagaagtgagaccttcaaattttcaatcaatctagtcttttatctatatcttgaatatatttccttgtttaaccaaatattcttccccaggtgttactgaaagtataaatgaccgaacacggcaaattaaaaagatcaaagatgaattgaataaattgaaggtaataatgaccttataaattgctcacgggtatatgtattattgctcccaacaatgatgaaagcttttggctgtagtatttggaggacgagtatgaaaggaagcttcaggaagatgcaaaagaattagagcaattgcagagtaaaaaaaatacatatgctgctaaagaagaggaatatgccaagaaaataagggaactggggccattgacatcagatgcttttgaggcgtaagtctttctttcaccattttttttttgtgtgtattagatgaattattttagagggatatgaaaagaaaactgaaagatgctatgaaaagcattaaaggactccacttctattagcaaaggaaaagtgacaattttcttccacattctatttgatattgtcaccttcttaactaagccttgtactcgtcagatattccaaacttctgcaatgatacattttcattgaacacatttgttctcactcctttatcattaaatatggcatggctaactcctgcatccattcagacaaagcatgtgtccaagcatatgaacaggaaaataatcctatctccaacaattttggattgttttgttatttcggttatttttttaaattaatattaggtatttagtcttttttgggggtaaacgtgattactgtgccatgatatgtttgatgatccgccagatatggtgctacagtgtatagcttgcagcattgaaatttatcattttctctgtactttgtttttagctaactttatttaattcctttcctttactcattgcaaatgccaggtatagacgaaggaatattaaagatttgcacaaaatgctgcacaggtgcaacgagcaattgcagcaattcagtcatgtaaacaagaaagcacttgaccagtatataaattttacagaacaacgagaagaacttcagaaaagacaggctgaacttgatgcaggagatgaggtactttgcagggattttcatttggaatgccctctattccccaaagaatcaaaagtctttgaggactacactgcttagcatatattgttagttctgcacttaactatctaaatgttttggtgcaactgatctgtcatggctctgaaagttgctttttatgtgcctctttagtaggtcttgttaaccaatcccctatatgtggaataacctaggaatgcttatgtctgatttgggttcaagcttgattttgcatgttggactgattccaatgcaactaatgtatcctacattgccatctcttttgacttattgtattgaataattacagaaaattaaggaactgatatcagtgctagatcaacggaaggacgagtcaatagaacgcactttcaaaggtgttgctaggcattttcgggaagtattttccgaacttgtgcagggggggcatggtcatctggttatgatgaaaaagaaggtttgtgatcattcttgacttagtgttaggattcaattgcaacgtatgagacttgaagtcccacattggaagcatgtgattctggtgtggggtttataaggccttgggctctccaactacaatagctaacttttgtggtgtggttctcccaaggttcttatcacgtttctattcagttcttttttgaatgagaaaaaatgttcataacttgttatcttggtttcacattttaaaatagttttaagtggacattattttcttaatgttttcatgtcctattgattccattttcttgtttgaatgtggtgcttaattattgctttatttctttgtattttgcttaaaaggtgtaaggaatctccagcaaaaagtttttttagtcattgtaattgatatgaaagtggtatttctgtattttgtatttcctttccctcaggatggtgatcatgatgacgacgaagatgaggatggtcctcgtgaagcaaatcctgaggggagagtagaaaagtacattggagtgaaagtgaaggcaagtgtattctttttatgcctttatttttatttttaattttaatgtaaagtttctgccagaatgctcgagggtttgttaactacacctgttgggatgaggctattgttgtttgtttcggaatgcttgagggtttgttttgtacattaaaagagtcagataatagtatggggtaggagatattttccttcatatctggagatatttttcctttctttcatttctggtttttatttagacttacgtaatgcaaccaatcaaaagcaaaactttatatcatgtaacaacacaaactgcattaaaatagctgtcattcactggttctttactgcagtttccccagcattgcttcaaaaaattagtgatttttatttctactattttacaagtacataacatagcatctaagttctgacatttctggacatttttatggcttgcaggtctcatttactggacaaggggagacacagtccatgaagcagttgtctgggggtcaaaaaactgttgtcgcccttacacttatctttgccatacagcgatgtgatccggctcccttttatctatttgatgagatcgatgcagcgctggatccacagtacagaactgctgttggaagtatcctttttatgcttgctatcatattatgtcaaatgtctggtcttgtgcaattcttccatctctatttactgcacacctcatcttccattaaatgaaattttatcgttcatattggaggtagtagaggtttaggttgatgttatatatggtgagtcttcaatcattgaaaacatacctgctattatgtacctatcacttaatgactcaactcaaaactgtgtggaatggaatgggatgggctgcaatgaaatggattgtttggatatttttatgatgagttgggaaaaaaatgtggttccgtcccatacccctcaaattggaggggaggaaaagtaggcggtattagggacagatggaatgcagtccattagattccatttcattgtatcctatcctatccaaacaatataacctaatattattccattccattatagtccgtacaatctcttttacatctcgtagattattttgaaaacatctaatgttattatatcttatattatccattacttagattatccagtaaggttagttttcccgtcttattctctgtaaacattggtttccacttccttatcccatgatatttttcctatttatttaggattattaatttgattaatatagataagggtttgtgctttaggttttatgaacaatatcatcagttatatttcatatcaagtcaatataatatttagtctctgttctctccgttttggtggtctcaatgagacaaggcttttgttgttgttatggttgtactagtttttggtgagatttaaatttaaaaattaattcatgcttgtgatattctttctgaatgatatatagatttcctattataccattgtcccttttggaattcttgatcttccatagatatgattcgtcgcttggctgacatagcaaacactcaatttattacaacaacattccgcccagagctagtgaaagttgctgataagatatatggagtaacacataaaaacagggtcagccgtgttaatgttgtatccaaggaagatgctctggaatttattgagcatgaccagacgcacaatgctgctgaataaggtcaatgttataatttatatgatactttatggttgtgatgattcctactcgtatttggagtttttccttctcttattaactaacttgggctagtgcaaaattttgcgactctgtagatagaagttaaagtataattgttgcatgcttttcattgagaagttacaagatttttctgagcatcataggtataacttttttaggcaattgtttaaatgacccaatgatcatacacattttctaatgatatacttggtcagttggttataatttttgaagtggtatttttatgtgttgttaggtgcttctgaatcacatggtctgaactgaaattagtcaactctgggactcttcgaagattgtgacgtagagattgcagaacctagttcattcaaattcttcaacctactatttatctgatgtgtagtgactggtgtgatgccaaccgaagtcttggagtaaccaaaaagcttggtcggatatgttttcaaagttgaaaaatgatctagtccccctcattgtacaaatgtaatcactttgtgtagtgttttagatttgttattttccattttatagtttataccaaaaaagtatcatgaggactttatctctttaaatgtaacaatacaacttgactgaaatttatttaggtttaatatggtttttggatatagaagattttagaaaagaaaataaaatctttcagaaaattatatatatatatatatattttaaaaatgttatttatttgcatccttagttaacctatagctgattaataaataaataatttaatttaatcagttaactttttactattaattattgcttatgtaaagatattggtggatatgcgtgaaaatttttcagggtcaagtaaattattggttaaataatatataattaacaaaatttaattaatgtatttctggaacatgcctcacatggctaataaatatttctattagaattttatcataattacgataactagttctaaattcttaatttccaaaagaaataatcattggtttattattcaatagttgtaagttgcaatagttatataagtgaatcgtgattcaatgaaccattttgaatcctagataaaagaactttatatccaaaagaaaataaaaaatataatgaaaattagataacccattgttttgttttagtttaaccttcttttatatttcgacatagaaactagaaatatatttcgtcatgagagaatatagagaacctaagtccatatcaacaaaatatagagatatgcttttaagaatttctcacgtcagttaaaattttcttgagtgtcgcatattataatggacaaattttctaccatgtcacatataataatagacaaattttctctctctcttatcttattgaaatttaattttaaacaataaaaagttaaaatgattaaattttaataaaagatttaataattttgtctaaaataaaataaaatatttaataataaattagcaattttaattaattaaaaattaaatttctctctatctattatttcctgtgtttttttttattaaaaaatagtactagtaccaataatagctaacccaacaatcttccgaaaaggctaagcccaacagcgtaccacaacaccagttaggcgccgtctagccggaagcaccgtatctgtggtgatcgcacgttaaaattcttgaaatctaaaacccttcgttctcttcatttcacaggtatgcttctatacacagacacttaatcttgtctcagtaattatcttccaggcatgatagcccaccacactgacttcattttacgtgtttgataaaatgcctgagttgtgtgaatcgtgtttacgttagctggttctgtgtttttgcgtgcccggaaccagccactgttaccctttggattcaagtttggattttgtgcataggggtcattgggttacttcaattccctccctttttcctccttattggtttcacccgtttgcgttggtaggaactaagaagtctgtttccaattcacccaattttcttatgttaattcaatagtttgagttttcatgcgtattgctatgcacatcatgtgaacatttgtttgtagagtacgaattgctttctaacgtatttttatttattttttgctggtttttattggataaggagatgtttaataatcagtttatacattattttccttttaattatttttaataaactatgcttccttgtgtgttgtgcttattgttgggagcctggcagtggtggcttacatatagggctgatttatttgtgtgttgttttctgagtcttgactagccctttgaagtttgaactgtagcaaaacagtagggaagaaactgaaaattggtataaagtgagatactgagagcactttttgttaattatcgcctgtctatcatgaaataatgtatagtacaacagtgatacttgatattttccttttatgtgggagagaacatatgctttatcttcgtgcaatttttgtgtctttgcttggggtgggcatggttatagagcaatgtctgatgaatgataatagggggtggtgattttcttttacttcacccttggtttgtgatttggtgaaactgtgttttgcagagtagaaagaacaaagaggagaaaatgaacaaggataagatcttcaagctagcaaaggggttcaggggtagagccaagaattgcataaggatagcaagggagagggttgagaaggccttgcaatactcctacagagaccgccgtaacaaaaagagggacatgcgatccctttggatccaaaggatcaatgctggcacccgcattcatggggtatgtcttctaactccttttcttctctcactaatccataatattttcaattcaatacttgaccaagaaattcaatattgctattgttgttttcatcaaactttgattgttgaccaagtttatttggttttctgctgagtaagagcctaaagtatgtttattagaaaataaccagttatttgttttgcgttagtttatgaatttgtgctaacaggaaaccaatcatactctaaaatcttggtgatgcaattgttatgattgtgaaccttgtggtaactctttcatatgcatgtctaacttggcaatgtctccacttgaaagctctcaaagcaaacccatgctttatatatttaaattattgctcctttaaataaggagcatggggaatatatagtcacattgtagttccgttccgatatccaaaggaaaatttctcatatgttgtgatgttacctacaaatctgagattctttgctttagcattgtctggaaactcaggactgacttccccaatcttcagttgggtttagttttctcctattaatgcataatttatttgtgaaatagctttcaatgagttccccctttccccaatcatatcatgtatccggtatcctcaaaactggaaggtccttttgttgcctatcttacaaacgtaagaccaagcaacttctattgttctcttgtcattgctttcagttataagctcagtaggatgtgagcttctaatggtaaatggtagaagtgaatttgtattctttattaagaagcataggagaatgtggatgagcaaaccagtaatttttttatattcagagatggattttgtctgtttgatgtgtgataagagaagaagccatgaaagtgaaaatgagtctttgaagcaaaatagctttcttggaagaaagattggattcttaggtgaactgtgaacatgcacctggattcaagctaactatatttcttgttctaaaatgactatgaactgaatgcatggtgtgtgcgagtgatacactttagcctcaaatggattgaatattaggtgaacctccctctggaatctgtaatttttctcatttatttaacacctctattgttccttttatttttgagtttatattttcatggacatattcttcttccattttctttgtcaataaacttttccttttatttgccaggtcaactatgggaacttcatgcatgggctgatgaaggagaatatccaacttaacagaaaggttctgtcagagatatctatgcatgaaccctatagcttcaagtctttggtagatatatcacgaaatgcatttcccggaaacaagaatgtggtggttcctcctagaaaggtggccttttagagcatgtggcactttagcaaacatttagtggtagtttatgttaaaatcgtgaactatctttgaggaattgggtgtagtacactatatattgctatcaattttgtatgcttgttattcacaaacttgtgtactttgtaactacatgatcttacccctccgctacctctttcaattgctttggtgtcagaaacattgtacaataataaaccttgatcccaactacgatcaattttatggatcattggctgccattagcctctataaaaaaataaagattttttttaatatatgttaaaattgggaagaacagttgtctctgaggttaccaaaccaattagaaagccaagtttataagataaaattgccaaggctccagcgtaaattttatttcaaatagcgtgcttcttttctagttctaaatggagtttctctaacgctttcattacaaaggtacacgtgtaaatcaattgtgagtctcattgtagaaaaggaaccgtgagacctttgggtaatctcattaatggttttagtacttggtggggtttgtagataacccaaatccaaatggaaatagaggatcataatatttatcgccaacattcattgggagctggtcaactgtcttgaaccatgttcttgctaacttgccagtgaatccgtagtcaccaaagagaagatcagttacaccttggccttcagtccctggaagccatgcagccacaagtgcgtctatttttgatagatatggctgaatcacaactggtcggccggtgatgagaactaccacacattgtatagacccacatacattggtgatggagcttggacctggctctggtatagtcaggttcaaactatcaccaaatgtttctgcataagggtgttcacctacaatgactatggcataagagaagttgttggacttgacaaagttggagtcaggattttctttgtagacaactttagtagcaggatcaattgtttgttttacagcatcaaggattgttgtacctgcaaggaaaatggtattttttttttgtcaagtatttgtaagtatcctacaaaaaaaacttatgatcaaatatctcaagttgctgtgtatgagtggttttcatgttaacccatgtaggttttagtgtgtgattagttttcaattggtgcacgttccatagcatgttcaagtgaatccatggacgtggtgtcattggattcaatgtttgtttcatgcttttgaacggaaaaccaaacacacctttatggttcagagttgatgctttttaacatgtaatactaaatagtccctccaatagtatagagtttaagtacccttatatacgcactcctaagccacctgagagatttctacaaagttagttttcagattaattttaaacacaccaaagttaagcatgttggcttaccgactgtgagattattgcccccaagcccctgccaggtaattgtccatcctccacattgataacccaaattgtcagcatgacttcctgccaccagtatttttgcagctttcttgggaaggggaagcagaggcttctcagcagatttaccattctttagcaacacaagtgatttccttacagcttcccttgctaactgtctatgctcctgtttaagacacaataattggtcaataaaataattctttccatttgaaagatatggtcgaaattacatccttgagaaaatatacctcactaccaagttggttcaccaggcttatatcagcatgaggattctcaaataggtccatgacaaattttactcttaagattcttctcacagcatcatcaatcctacttactggaataatattgttctttacttgataagtcaggacatcaatgaattcggtgaaattaaagggaaccatgatctgtaaaataatgaaagtcataaactcataataaatgaaaagtcattacattaaattttagacactcaattcataatatttctttcttttgttaccatatcaattccagcactaacaccaacttgaatagagtacgaatagttagaatgaggaggagaagtaatcctgtcaatgcctagccaatctgatatgacaaaaccctgaaagataccaaaaaataaacctaaggtacatcacaagctgcatgtttactcatcttcaatttgatggaagaccattttctgattttaaaaatagacttaattggcctaaaaagcaaaacttagaaaaccaaaatcgcacataattgaaagaaccaaaagtactcgtcaattgctttattggagaattaatcaaataagttttatttattaccctgaacttcagtttgttcttgaggtaatcagtgacaagaaaatgattagcatgcatcttttggccattccagctagagtaggagaccattactgttgaaacccccttgacaatggagtcatgatatgcaggcatgtgaattcgaagcaatccattataactgacaacagtattgttctcattaatgcccttggttgtgccaccatctcctacatagtgtttagcacaagctgcaaccttgttcctgtgtcaaagtaaataaaatgttgaaggtctatattgtaaccccaaaaaatgtgatttctaatacagcaaaggttaatcagcaacggctaataagataaagaaaaacgcttttacagttctttgttttctgtttctggctagaccatgtatactccaataacatctatacaaattaatataccttgcgctacatattagagacttttgaaattcggggttatggtatcccactcccacaataaggtttgccaataaatcaaatatatattgtccaagtagaaactggtcatgtggcatgtaggtattaataaatatccggagaacattgactttcatcaaactaccaattccagaatgcagaagttcttttcttcattaactgaatatttaggcaagggtatagtgtctttatatttgaaacaatattcaagttttaatattttaaaacttatagaagtaaaagaacaaaatttgtacactgaaatccccgaagaataaaaaaaaggtaaaagattgtataaatacaatgcaatgcttttgcctaaaaaacacaaaaaatataaattgcagtaaatcttttaatagttatcaattataaacaagaagtggacaccaactgaatgactattaccatccaacatatgtgcatggaagtatatataaagtcaaggatgaccaattaatctaatgatttacattgaactcaatagctattttattttaattttgcagtgtaaagttacaacccagaatcttactttccagcgacaaagggaaccccctttctagaattgccactgatgtctccttgcaaaccaggaataatttcagtcattgcttgaacaatcttagggtcttcactatagctttcatagcaacgtccccatctaggatctctgcagacctgtggaagaataaggctattaagtatcaacatagtaggacactagatcaatgttaaacttttatgtcatctagaaaaaataagaatcaacactttcttaattaccgcaatgcatggagcaaacacatattgaattccagtagctctaacttcaagggcagttgcatctccaatcttctttatcagcactggatccctatcagcattatataattatggctatttattcagttaagcagctagatagtgcaaacagataaaaaataataataattcattttaaagatctaaaaagtctcaataataaaatttgacagtccaatttgatttatctcttaatgaaggataattaattgaagggtctagtgataaatcaaatgttagcatattgaaatattcaactgcatataacagcattagcatttgaaaaaccaaggtcttcatattacaagtaaataaaaaaagttaacatgactactatttgagtacatgtatacttgcctggtaactcctagcccaacattgtggggaaaaatggttgccttgtagacattattgtggccatgaactgcatctattccataaatcattggaatcccaaggcgggtagacaaagatccattttggatcccattcaccatttggatccaagtctcagcaggggcctttgtttctggaacactccctcccccactcagcacactccctgcccatcaatcatcacatcacttatatttctttaatatatgtcacctccataatagcaaacactgttatgccccttatgttatacaaatcatacacttggataaggaaaataaaacattactaactattaagcatagtaaactatagcatagcatataaggaaccagtatttggttagagtttggatgagagcaatttaccaatgaagtacttcttcatcacttgaggggtggcaacacttcgttcaatctgcaccatttggcctatcttctcctccagggtcattcgcttcagcaagtccttgattctaacattcagtggctgttttgggtctttgtacttcaagtattctgcttgtgaaacagaaaccaggcagcaaaatagaagaaccaacacaaggggtgttgaaattgcccccatttgaacacttgaaagttgaacctgcatatagtgaaatattttcacaataggcatataatgttaatccctttaattgacatgcatatgaagcaagagaataacatgtcaatctgaatatacatgaaaatggagcatagttaaaggcataaaggaaaggttaccagtattctaggcactgaagtgaagtgaagaagttgaatggagtgtgaggagggagacaataaagggggtttgagagtgaggtatgctaatttaagaaaacttttaaggtggtccaaaattattattatccctactccttaataatctttagttgtttatataatacataattaagtgttattattttttcaaataaattaaaagtaagtatatatgatgtagaaattgatcaagactatatacacagttccaaactatctaattaatgtagaaattaatcaagactatatacatggagagtgagagcagctgtcagtgattggtcccagtacagttacagcctgtgcttctcaactacattcttatatatatatatatatatatgctgacattagttatgtgaatcatatcattacctttcagtattaacgtactaatcataaatagtaaagaaagtttacttttcatgcaatctaactgtaagaatctttactctgttggattgggatatattgtgctgtagttgttaattatgtcttatggtaattgttctttttgtactggtggtactatagcttgtaaaatttgttggtgatgtatttactgctatattctgttgttcgactatttcttgtgaactctaatatgttaataaaatatactttattgactgttataaaaactatcaattaattataaattatgttagatataacttttaagataatttttataaaaactaataaatttgcatgttataattggttggtagtttagaaaatagaaaccttaaaaccttctcattttacaccgtttacatttaaatgagtttaatattgtattatcatttaattataaattatcatttgaattttttaaaataattattttaaaagtcaataaatttattatacatgataggtttagatgattgcttaaattttttctcattcaattaaaacagattttcttttagtttattttattacgttgaagtttctgctcatgacttgctcctagatcctgcatttttatttttccggagtcggtgagtgaagcaaggggggaatttagaacagaaaagctcgtgactttcaaattaaaattcatgggcagcagtacgtacgttcgatcgatactgcatcatctaatacaatggtccgcaggatcgtaatattaaactaactttattttttctcccttagtttgggaaacatttcatatgttgtaattttgattgtatctaacatttttgtctatgcccacatcatgtttgtaagaagttaaaaaaatataaaaaatattgagggttttatattaagtaaaaaatcaattaaaaaaactgtaaaactaacataacaaatgcttaatttaaatttaaagaattaacaatgtaatgaaaccaaaaatttactgaacattttaagttgtttcaaatttattgtgtttgtatccctgttaattgaatacctctttattaagctacagaacatttgcctaaaaattgtgtccactgttagattgtacgctgatagtgacatgtttatatgtcttctcgccattcacaatttttgttggcaaatgttgctttctgtttcagcggggacacaagtcatctcgtgatgtctagcttaataattcatacaaatccgaaacacaagaagagtatgtacttttttaatcaaaagtattgatgtagtcgtataatgttttattgattattgtatttatataagtgaaaataatttatttaatagaaaaatttatgaatcattgataagaaaacatcttgagaatacaaagtatgcaactaaaattttatataaccatttattattctttttatattcatcttaagaaataattttgtattgtcctgactttacaaaccaaacattttccatttatcaaatcaaatttaaagcaacgtgcctttaactttccctcctttattttacgaaacacaagtctatcatcattttatgggacctatcatcatattttatgggacaagggacaacggtgtcctgcatgcacctggcatcttatttaaggaggaaattcatcttgtaaacacgtgtctcttactctatttgacacattgcttatatttcatatcatgcatatgcggcatcatattcaaattaatatgcattaattttatcttgaaaaaaaattagtacttacaaaataacaaattacagtatgaaactttgtcggcagtgtttgtattaagaaactgactatatctttcttataaataatgttcctgaaaaagaaatgataaactatttttaaaaatgtttattgaaatactcttttaaatattattatttataattaagtgaattgtagtaaataatttagaaaaagtcttataagaagaatcaagaagggcatcgaaggtgcaacattttagtgttaaggtgtaatataagaattagaagaattctactttcataatacttttctataataaattttacaattaaagagatacaaaggaaaggaagagataagatccatgacgtgctgaaaaaacacaagactttagattctaaccttgtcgctaacaaaaaaaaaaaagtagatatattaatatcattgttgccaagttactaaactaagtttgttctaaaaaaatcatttaaaaaaacattttaagggccaatcgaaatgctctgcagtcatgaatttttactagcacttatcaattacctagatcttccagagagtattttagaactgcaagaggtgcagtttaattaaaatatatagctgcaaacttcctaatttaatttggttaacaaaaaattatcttataaaaattgaattgctgatatgaatgaattcagccgcacaccaaataaaaaccgtataccaatttttataacgagcaatttcatttcttaaaacggtttggttaataattaaagcatgcttatgtggatgttagagcattcaagcaagatgcaagacacttttaacttagacataactggagaacataactgtccagctagtccttttccttgctgcaaaaactacccagctgaaccagcttgtgtttcttattgtaaacataaaaattttaaaaaaattccactagcatgatcattatgtgaaataaaataaaagaaaaactccacttatttattttaccaaaaggaatgaaaattggatagaataagatcattcttccaacttatttaggatagtgagcaccattatgtccttcccatttcccatttcaagtatctttctacaatgtccagtccacagagttccttgaccacaggcatggttgcagggacccccaactgaaatgttgaatcttcttcatcttggttgctccatgaaagaagctgtttccttgcttcttttacagctgctcttgtggcacagtgaatggaagccgcaagaagtaatggcggctcgccagaagctgcagcaacaaatttcaattttttttttcattttagattttcaaactggaataagtgaagctttctcaatcttattaagagtcttaaataaaaggtttaaatacctttttagttattgcaaattactatttttgtctctaattacaagaacattttcagaaatttttttatccttttttataagatcatttgttaatttttagatgcatttttttcatacttttatttaattattctctcttcaaacattaataaaataattaaatggatagagaaataaaaaatataaaataattaaatggatagagaaataaaaaatataattttgaaatgataatataaataattgataaatttaatatttaatatgattaattaaattaattatttttgttagggatagggaggagggagaactttctaagtttacaaacacgattattttttttaccaaactattatgcagatgaaattgaattaatcattatgtgttccatccacttccatcctcaggcttgatatcgaactgttttttttatttattttaaattttctgttccagaggcattacatgcatctcgtacccaagctcgtatattatttaattagttactttccagtacaaaagatattgttaacaaatatttatgtctttatcatacctagattttgaaattgaactgttagaataaactataatgaatcaatgaaagacagtgcacaaaactacccatttcatgtataagtgaggtgcattcatgagaaaaaaataaataagaccgaccaatttcacaaacaggtttttgataactccttgctcataccttttgaagagagaacacgttgctggtggtgcccactgttgaggacttgaacattaaactgtttaggtatagtgtctatcgtagggattttgtagttccaagtgccgttttgcaacaccaaaccatcaagatttgtttcatattcttcaagcatgaaaaatcctaacccctggacaaaagctccttcaatctgcaggatacaattgtattgttaagaaggataaatattcatactgaaataactgaatagttgtaagtagtaagagaccataaacattctaggacctccaattaggagttgattattgtgttttccacttttactattaaatttaatttttggcatagggaatagtgtgccagttcaatgtccttttttactcccagagggtcttgatgtgagaagttgtgtaaataaaaactatttttggacccaactcttgtgttattccttggtatgggctgagcttgcttagcaaatatgtagttggcttacctgtcctaaatccacagcagggtttagactctgtccacaatcataaataatatctgtttgcaaaaatctggtttctccattcagaagatctatttccacctgagaaataatttccaatatttagaatatcagtataaaaaaagttggctcaaaaacatggtttgtgtgaaaatatacattagcaattaacattcaagagaagtaattatcaaagaactagagaaaataccattttgatttgagatgtgcatataaaacaaaaaataaaaccgacctacctcacttactgcagcaccataattcaggtaactcagagagttaatactgggtgcatacaatgaagatgctgataagttcacagcttgcatgtgtgcctgtacgttaataaattgtcagcaacatggtgattaaatataaatgcttgtgggctaggaaaataagaagaaattctctaccaattccatttgcacatgaaattccctgaatattttcctaattatagtaattatgaaccaataaattgtgagaacgctaattgccagtgtgccatcttccgcactacatactccaagaccttaacaggaaaagcctgaagcaatacatctcatgcacaattacaaatactaataataatgtacatgcatcaatgtgaattgaaaaacacaagtttgtaaacctttcagtggtcagtagtgaaattcaatcataaatagtctgtccacatggatcataaagagagaaaacagttaagttgccacttgcttcatgttatgaagagaactggttttatcttctgggaacttcctcccacaacaatcatgaagataactcttttaagaggaaaatttatcaatgttcaaaattgagctcttttactttatttatagtagctacctgaagaataagggtctcccacttgatagagcccatttcctcctgcagcttttccttaagaggctttagcctctctaccaagatattacagcaaagcctaactgcttcgcagcttgactctgatgtagtgctcccagcagtgaagcctccttgagtcaagctcaccgtatcagattgcacaacccgtactttgtccaaaagaccttcagttccatcacattgaatagcaccgagaccatatgcagccatctgtttcacctttgtccaaagaccttgacccaattcaattcctccaacttcaacaacgacagacccatctaaaaaaatacttacttttccaggagttggtcttagagtcagttgaatcacaactggtactcgagaaattccccttttcttccaggtgttaatcctgttgaactcttgcaccaatttatttctctggtcatagtttgcagaaacagccaacttactccatattgaaggcaaagtatactcataaggttcaccatgatagtactcatagaatgactgaagacttttgtgtgtgtgaagattaacgcttctgacagaatctacatccattaaaagtgtagctgcaacattttctataatagcttcagctataaatgatccctgaacctccccagggcccctcattgcagatctacttggatgatttgttctgcataactttatatcaaaagatagtgcaccccagtcgtactttttaagtgcgtaaactatagcgtttggcataattgcacttacatccacatatattcctgcattgaccaatatctgaagttctagtgcagtaatcttaccatcattcctaaacccaacactgtaagttatcttcatgggatgccttcctccagccattatcatatctgtctttcgatttagatacattctaactgggcgctgtaatttctgtgctgctagtgcacatgatgtggcaacctgcatgatccaatggttagtattatagacagttagacacatgcatgcatatgtaattttcatatataacttatctactactgaatcttttctgcaatcttacaggatgggttagaaaaagggagaagataaagcacattatattttgaagaaagaaggaaataaaaagacagaagtacaaaaccattttattctaattccaggcttgccgttgacaattatatcatgcaacatataatggaaagaagctacttatatggacatttcaagatgatgtgacatgacataagcttcttttataatccactggagtaaacttcttttacagtttcacaaatttgtctaataagagcacatactaatatgtctacagaaatatggtgataagaaaagaaaaaaaattcagattatcggtgatacagaaaatttgaagcttcaccctctacattgaaaaaaaagtgatagagatgagtaatatattagattttcaaaatattaaagcataactaaatacttacagatactgcttttatggcctttccaccaaaaccacccccaacccttcttgtaattacacgaacattattttcaggaattcctaggcatcttgctatagtagaatgcacaaactcagggcattggtttgaggagtagactgtaatgcaattgtcttcatctggaacagcaagtgcagtttgtgtctccatatagaaatagtattgagacccaagtttcaactgcatttaacattgaatttgatagataacaatgaatatttgttcagcataaccaattaaacattaattattcaggagcaaacttaaatattgcatcagaaaccaaggtttacaaaggtatggaatgagaggaagaggggaagcagagtaaataatgtacctcagcagaaagaatcttgtgatccgcttcagccattccttttgatatatcaccaacatgttttggataaagaaaaggaggaacttcaaaaaagctagatctttcaacagcatcttcaacggatagaataggtggttcaagattttcggtatcataatcaacaacagctgagtttgcagccatatctgcaagtttctgagtatctgcgacctaaagaaggtattcggtgactaaaatggtagtatttcacatatcaatctccaaagaaatgaaaaagaagctcatactttattggatcaaaatgagggatataagaactcaccacaaaggctagtcgttcaccaacacatctggctatctcttcagcaaagagaggttcaaccccaaatatactcttagatccaatgttttccccaccattgggaatgtctttacttgaaatgatatccctcaatccatccaattgcaattcaggtgtgagttttatactcctaacccttgctaaaggttttgcactataaatatatgctccatgtaagcaatttgatggtgatggaatgtcatccacaaacacaacctcacctatacatgatgattattcataaatatgtacttgttactgaacaaaaatttaaaaaattaaacatgaaaagttataaatgacaggcaccaaaacaggataaaataaatctcacacacaaaatctagtctatggcctgcagtacaaagtggactttttagcatagttatcttgacaatagttataaggtaaccagagacaagatgcaaaatatggatacgcaattcatcagaaccaagagcaaggggaacaagttttttatgaacataggggttttgacttctgctatgtagcaattggttataaaatgctactaaatgaatataccaacatggtgtgacatggttggtttttaagcatgtggtcaggtgtttgatccctggtccatgtatatggaaaaacatctgttgggagaggttagacccttaaatggatctacgtacctcgagggattagtccttggctctctgccgagggataccccggattcaaccaaaaaaaataccaaactgctccaaagcaagagatcactgttgggtactgaacaatcaagataggagaaagtgagaaagggaagaagaaaacaacatgcagaatttatcctggttcacccaatgtgagctacgtccagctattcactatatttcctcacacacttgtacaattgcactcagattacaaggaaatatataggcttagaaaccctaagcatcgtagctattcatgggctcaagcccaaactacaaataataaaacacgaggccaacaacagtactaggcctctagccccctagccccagccggggagactctcctgggcccccgtgcatatctactgacgacacaatttgagccatacctaacaatcacaggaagggaaaagggggaaggcttttagagaggcaaaaatctgacacatttactagcttgttgctacaagcttctaaggagaaagagagacatatttttatgaacctgacaaagagattgatgtcacatattcagtggaagtgaataatgatgggcagtccaacacacaattctgcaagcattgtaggatctagagagggtaaaatgtatacaactgtataccaccagatcacaagcttacaaccctaaaattgcacaaggactcactttctagcaaatggaatataatacaaaaaattaccaacttttttcatgtaaatatttaagtttagtactttgaaacaattatagaaatgcaaagacagaaggcagtcaatcaattcaaaactcaatgatacaaaacaaacctgaagcttgtagtgcagctccagatttcatgattggctcaccaacaggatgatagtcacagcctgcttcaaggatttgcttaccagatgacagtaaagttggaactttgtcatgacgaacctgcttctgattctcttttaactcaaaatccttagcataaggaagattaatatgtccatttaaataaccattgtttattgcggaagcgtcaagaagtgggttaaagaactgaaaaataaaagcagctgccaaacttgaacggtaagtggtttttgaggtatcatctttaggtacaatagtggctgtaaccaagatgacagcatcgtatagaatgctagcacttaaaagctttccagctaaaaactcctcaacattttttgctctgattgcatgcttactcccataagcaccaaaagacaacctacacgtgtcaatcatagttccaccagaatccttgcattgagacaccttaaccaggaaagcagaatttaagtaagaaagggcatttccaaggggtcgaggagaagctcggtaagtttcaaagaggaatctacttcttggttctgatgattcacttatattgagttccaaactaggaattttaatgctcaaaagcacactttccaaacctaatggcggtctttcgagaaattcctctaatgttagccactcaaattgtataccagtcattatgtgaaccattgcatctacagcaagaagtattgtagcaatatctgagggaaaattattcttctgtgccataactaaatttccacctacactggctgtgttccgaatatatcctgaggcaactttgctcatatggtcagcaatcttttcaagtatcatcacataatctgaaagaaagtcacttctgctctcttccttcagtgcttcaatagctttagatattgtcactgctgctccaatttcaatccctgtttgatcctttctgatctttgaaagctcagaaattccccttagatcaatgtacttatcataggcttccttttctttgtaatatcccatacctgtattactaacaacaatttttatccgggttccattatcatggtttaatttcaataagctctgaagctccattagactaataggtctgtgccaactgtgtttctcagaagccaagaacacatcatgtttgatttccttcaaaaacaaaggaaatctactattcattttattacggtcatattgaggcaacctactaacctttaagtccttgctgtctccctttctccagaaagagttgaaccccaaatcctccatatcaacatcagctgcaaagcttttgcagacatcagcaatcggtcgatacccagtacagcgacaaagattccctgcaattgccttttcagcctcagcaacagttacttttgagaacccagcaggtggctctggacaagtaatcttttcagcattgacaagagttccaaagagggaaacacacattccaggagtacaaaagccacattgagtggcatggaatcctgaaaatctttcatgtattgggtggaatccttctttagaatttccaatgccttcactagttgttattgaacagccatgtatgctgcaaagtagtgtgagacaagagcttgctgtaaaatcctcaacttggtcaagcacaggatcgtatttggagattaaaactacacaagcgccacaaccccctgaaaccaaccaaccatgtctaaacatgaagtaccaagttggaaaaataaaataaaaattggactactaaaacacctccttcatcttcatgatttgagcatcagaaaaataagatgaattcccccgcctaaatatatagggtgcagatcaaattattccaagaaaaacacttggcagagttactccattcaataattctctctctctctctcaacgattcattagattaaaagttttcattgaatagcttaaatttacaatttcttatagtttcaaaattatttagtacttttatccacgcatactgtttagccaaaattcaaccaacttagttagattctttatgattgaaatgatattaaaatgtttatgggttgcattgcggaaatttaatatatacaaaaagttatggagaacattaacactatcaagagttacttttggaagaacttatcatatataaatgaaaatgaaaattattgatatagctcaagaataatatgaaccggtacagtacatgttttttttttttacagaagtacagtacatgtttttttgtttgtttgacagaagtacattacatgcttatgatcagcctaatcaatatactgacttataattcttccattgtatctgcttcttaaaagggccagaaaaggggtattggacaatttaaagtgacggtaagcataaagggagtacaactaagtgtaaaaactgaagcagcaccctacaaggtcacaacagctttgaactaacccgtttgacctggaactggaaaatcatcccaagaccatcaaaatttattcaggatttcaccaagtggaaccacaattaatcttacagagaaggaaggagaaagaaaatgaatctatatcgtaaataccaagcttattgaaataggaaatacaaaaaaagataaatggttgaacacaaacttatagtatataccttcaccacaaccgagcttgacactcttgaaacgagtacgagtgcgtaagaattggagcaaagtggttgaagggtcaacgtggcagagctcaaacctctcaccattaacaccaaaaaccaaacttgttggtttggtggtgtcttctccagttccatagttcagcaagtgttatttcgatcagtttttatcagcaacagaagaaaactttaaactctcataattaatgtgtgcgagtcggcgttccttactgttctcgatcgacgtgggcacaatgttaattttttcaaaacgcatgtggaattggtatcataatttctaattcattctgtgactgtcacctcaaccactgtcacctcaaccagctaattcaacaaatactttattgattccttagttactctatatatgcactttctcacccacctttccatgctgctccatgcaaatgttaattttttttatcaataaatattaatttattaaaatattaattttatctgaagaacagagaagatcaaattcgacaacctttttcttattttttaatcatccaactcactttaaatttctaaacaaaaaatgtattaggacttgaatcctcttccctaaaaatctttcctccatctctctaatgataggggtgactttatctatttctaactagtatttttttattcattatctctttatttcttgttaaaaaattgtctttgacttttttagctgtagactgcagtgtagtgtgaaaggtccgttttgatattggaagagatagaaaatgacaaaagataagataaggattgagaagatggacttgtggttgtaagttttaacgaagaaggcaaaaccaaagagccaggcacaaaactcaacgagaaaatagcgattagtgcgcagggcccaggcaggtaagagaagaaaaactgtgttagacatgaaaatcagtgatgtgaaggtagcaatataatgatatcactgattataatgattaattaaaaatataatttctttttcacaaaataagtgttgtctttcattattttatataaattaagaaaaattaatagataaataaaaataaatattaattttataaaattaaatttattaaatgaatgaatgagaatattattaatattagattaaaaattaaaataatatttattaggaatattagtacaaaataagtgatggaaagatagcaatagtatgactgaccattgattataatatacttctttcgtcacaaaataaatgtagtttaatattattttacataaattaagaaaaattaataaatagataaaagagagtaataattttataaaattaatcttattaaatagatgaaaaagaatagtattgagacatctatggacaaaattataaaaaaaataagatacacatcaatgttttaagagtttaatttttatacatttgtcaatcaattacaaatcatgatatgcatgacttttaaagagattattgttaaaagtcaacaaatttatcacatataataatttatagtagaataacactataaaagttatttacagtatcaatgaatataatatttactcatgtttaaaatatagattctacatggtgaataagagtcttccacttgacaatccattttcgacaaatttaaataaataatatttttttaataaataattcaaaataagggattgtttttaaaataatttgaaatatggaattgtcaaatacgcccaatttaggtgtgactttcgtcgctaattcggtcgctaaatgtttccgaccacgaattccgactcaaaatgtttaagcgactgaaacagagactgaaattagcatacgactttaaaatcaattttttaatttacactaatttttttcaatttttgaaattagttttttaatttttttaaaactgaaatcgtttaaaaatttatagtataattttggtaaataaatatacaaaaaaaattaccttatttgggttatttggcaaaaaaagaatgtgtataaaataatatatatatatatatatatatatatatataattacgaacactttggtaagtttattttaaaaaaaactctcatttctcattttctgctcatatgtagaggaaacctaaaacaatggtagtcctatttgtaaaacctattatctcctctgtctaacctaaaccttaatatataaatctagttcttaaatagataggagaaaaatagagaatgtgaaagggaaaaatacgatcaaactcatccctttaatttttaacttttgttttctttttaggatttaatgttctttgtctctcttatttttgctttgactaaacaaatacacactactctaatctcaaaccaataccgataaccactacaaattaaggtggagcttcatttaagtattttttttatttttatttccaaagaaaataaaaaataagagtaaaaattatttacttaaaatttagaaaacattttttcaaaaaatatttttaaaaagaggtacaaaactgaaaacaacaaatctaaaaaataatttatatatatatatatatatatatatatatattggattaaaatacctcttatgctccttaataaaatttctatttattgataaaagaaatcaataagagaccaaagaaagagatgtcgtcatcttaatgtgggacaaaactttcatacattaacatgatactattgttggtttgatttgcaaacaaaatttgtaatacattttaaattggcttgtaacgcatggataaatttcgagttcgagtgaatttcgagcgtataaactgcaaacggtcataactttttatagaaatgtccgatggagacgtacgatatgtaaaaacgcttgaaattcagataagtaattaaaaaaataaagaataacattaaattaactaattaaataattaaaaaagtaaacaaaaaagaaatttttggatgattgaattctaaatcctaattttgaagcacttagaggcattttttgaaaaaaatagttgaccaaatttccttcggtaattttcctaggccttcctctctcaatttcgagctctttgacataaatcacgcctcaatcggacattcctatcaaaagttatgaccgtttgaagtttatgtacactacgagtcaaaatgacatgtaccacaaccatgtgaaatacgcctaaattttataaaataatatattcttacttgaaatgattttattaaaatattcttacttttaatatatgcatattatttataagttacaactattggatgattaatcgtggtggataaaaaattgataagcacggtactaaaacaaattatcatattgatatgattttatttaggatggaatcgaaataaaaaaaaaaattaatctcatcaaaaattaaaaacttcgttcaatatgaaattcttttggaatactaaaacatcagtcatcttgaattgaaaagaataaattgttggcataattccaggggcggattataacaaatactgaaaataattaacaagcaatacaaacaagtgctaaggatatattaaaattttaatgacaaaatttaaggggaacagaatataacatgcactgaaaataattaacaagtaccgtaaataagtgttcatggtatattaaaattttaatgacaaaatttaagaggggacactgtcccccaacttataagctagatccacctctgctgacaaggtcgtaactaccctataagacgcaagttaattttcattgcttcttttataaaaaatttaaaataagaacattttcgtttttttaacttggaatttaaggggggcacttgcccccttctctagtacgtgcatctggctctgcataatactctgtggagtaaatcatttttaaggagtagattagtcctctttaattgcactaatcatttaaaaaggattgtttaatttcatttgataatccaatttaatttgttttgataatcaagatcggtcatggatgaggccgaaaagaaacttcacgtaacaaaggctatatatagccgaatatctcatccatccatcatatatatattctctttcctcactggttattatataatgataaatttaacagttaatccaatgttggtcggacaaaataattaaggtggagcgaaaccaagctagatagcttgtgtagcagtcgtgttttgaaaatttaactgaacagtttaatcaaaaaatagaaattggtggattgatgaagtgtttagtccaaataaaccacataatcattagtctggaaaaaatcggttaaagttaaacaataggaaagcagaaattaaattaaagctagtcaaaatgggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgattaattaactttgaaaagaactaaatttcacattttttttcaaaattgagttctaaacaaaatctattatatataattccaattcttttcttcctttcgaaatttaattatagaaagatactagaaagaaaataataaataaaaacaataagatgcttttttattgagtattttttatcattgagaaaacaaagataaactacaaaccaataaatacactcctcgtagcatcaaccatgagacaagatagcatgtgaattggacaagaatccataatctctgtattaggtgttgatagtatagatcgcccacaaatttaaatttaaattgatctaaatcaatttaagttggattggataatttttatatttgggtaaaacttgaactaaatcaattaaattattattataaatatatacaatataattggttcaaatatgttacagaaagatggtagtagaacatatattttgactttaaatttgtttcaaaatattataattttagttgaaatttcaattacattactcatttcactatttgagaacattaaaattttcaaactttgatgaaatagttatagtttgttttaagctttctggaattttcaaactttgatgaaatagttatagtttgttttaagctttgtgggtgtgatggttatttattatatttcaatttttaaatcatatttaaaataatatgttagtctaatgtgatgatgatgacaaattgacaataatgtgattctcctttatttttttcttcactatttgactataagtaacaattataagtaatatattacgatatttcatttaataaaaaatttagcctataaaaaatattgcattaaaaaaaagaatccaatcaaagtcgaattgtttacaaatgaattgatttaagttggatttcatttttttccttgaaaaattgactcaaatcaacccgttcatatttaattagattaagtcacgagttttatcaaattaatctaaaccaacccgagtacactcatattattcacactcacttgtcccgctcacgtgtttccttctctataagtgtgttgaaacttcaactcctccctaggataaggcatgaaggatcttatgctatttatgagagttgcatgatcgtggaagggaggagaaccttgcttgatgagcgtgatccatgttagagaatctgattccacaatgaaatgtctatgatttaagttccaagcacgctgaagtccatgataaatgcctaagtgtttcgcatgaatattcgttgtgtcaccacaagatatgtagaaacataccttgaatccattgcccgagtttccaataatactcactaatatgatttgttgaacaacttattagtataaatcttttctatatttatttctcagttacacaacaaccaccaaaaccctaaggacccgtattactgaaagagctgtcatctgtatttaatttgaagaaaggtgaggtaggaatacaccatgtttttgtatcgacggttttactaagaaccgtcttagaaagtgaggttacaaagacgcactactagaaaaaagactttttacatcggttattttggacttttaacatcggttttgaaccgatgttgaaactaccgacgttgaaagtatcaatattaacatcggtttttgaaaaccgatgttaacataactacacaacatcggttattgttaaaaaccgatgttgtttaataagaaattaacaaaaaaaaatgtaaaatatgcaaaaaatcaacatcggtttttagaacaaccgatgtaaaaatgacacattctacatcggttatagacacaaccgatgtagagatggccttttccacatctgcttacaactgacgttgtatagtccttttctaaatcgtttattacataaccgatttagaatttccttttttgaaaataaatgtagcctattctttttattttcctccttgtaatattaaaaaaacgtattaaaagcttaaacaaaatttttaagacacttctattaacaattaatataaatactcatacaatcatatatcaaaaaaaaatatttgtccctttttcatatatattctgcaatgaaaaaaaaagaagataactttaaataaagagaacaagaaagatatataagaacaaaaaaagttagtataggtgtgtccacattaatacatagtcaatatggtgggcaggtcatattatttccaacactttggtcatgatatatttatttacaagactcaatctcaattataaaaacaatcatatcaatactcacttaaaattgttgtcctttcatgtgttatttatttataacttttttgaagctttagtaattaagtactttaatgactaatcacagttaattatatgtgttcaatttttttttgaagttttagtaattaagtactttagcaattaattaattatttattttacattaatgttttttttaaatatccttgtcaaatacatacaaaatagttccagtgtctacacaaccaattcaaataaattataataccatattcggataaattacgactacctttatgactttggtgtacttactcccatgttgcatgttatcttcctccaccaatatattcctcgtgcattcttaccctgtccattaaataagtggccttataaggtagttgttatgaaataaacttgtctaacaataaactttgttaatttcttcttcaaaggaaagatttataatttaaaactcaagatttcttattaaattaattagaataatgtcatattagttgagtcacatatttagtggtagactaaaaagttaaatgaattaaataatactaatcatttatactaaaaaagttgaatcacacacacgtgtatatatatatatatatatatatatattccaactaattttaacttgtaattaagctacatataatgaagaattaaactcttttcaaattaaaacttattatctaattcaagacttatggcatttacatggattcaatgtccataataccttgatgtctcttcttgaatgtgtaaaaaagttcatccctaatgacaaaatctgaaaattgattgcatcagaatatatacaaaagtacaattatgacgcaggacaaagtgacaagcaagaggactactcaaatctcaatagtacataagattcttaaaaaagctatatgttgagttcctagcttcctcaacccaattatcaagatcagaactcctcaccaatctactatgccgcaagagccaatggagcatactgacaaaccaactgcaccacatgtatagcggatccaattttgagttattttccttggatttttatgtttgatgacctgaaacatattacaaccataaaattgaaatttaaaattttactgatattacttaacaaaccaatcaattggaatcggagtgattgatattctaagattctgagtggggatgcactgactgtaaagccttttatataaagtccaattccataaaaataatgggaaatcaaaacaaattgaattttgagaaatggcaagcatgacaagtcaaaaggcccaaatgccaaaactatagcataaaattaaagataatagcagaagcaagtaaatggtagagagcactagagttaaacaatgcaaatttaacacattggtaggaaaagagcactagagttaccagcagactgtcataggtcacagaggcaatgcataagtcacttcattattacatgatagcaatatgcaaacaagagatagaacatagaagaaatttcagcaacatcagaatatattcacacaatcatattagtgccacttgccaccatgtctcataaaaaataatgtttttagagtgactgaattacttattataaatttgaaatattataatatttcatacgaataaaaacaggatgcttaaaaatatatcatacgaatatatgggatgagaaaacaatcttaaaagtattttaagaatgcttcaagtttcaactaaaatgtatatatttattttttctacataacatttactttttttagtaatttttttatcaataataatcaaaatttgtgtaaaaaaaatctagatagactactcaaacaacttaattagattccacagttttattttattttttggttctagaggcttccattactcattcatataatattattaagtactactaactactaagagaattagagtactgcatttaatagtcattcatataatattagaaacattcatataacagggtgtaacattcaggatattaaaaggtgccacacgtaattggctacaattttgctacaattcaggatatctagtgggacccgaaatattgctacaatttttggtctcttaagccaactatgagactatttctcagtccagagtttagtcacttaaactctttgccatctacaataacaataacttaaagcttcttttttattttaataggaataacttaaagtttatgacaagattaaagctcaaagcttcatataatttgcagccatattattttaagcataaacaacttatttaaaactatcaattctaagatgaaacatcctatatcgttaaataattattaaatagccttatacactataaatttcatttcattataagataaaatgaatggtggaagtttaaacttcaaagtacctgatgtccatgagaaagatgtccacatgaggaagatcaagttccatgattctttcatgaggtttaagcaatgcagtgtaaacatggaaatttgcaggagaccttgacagaggctgcacgttcactgcaattaaggggtaacagcgacatatcagaacacttaaacaaacacataatacttttaatgaatctattgaacatcaagaaattataattcattggaataacaacatgctggtaattcaataaaaccatttcaactttgagccatcaatatgttaaaatccaaacttgaacccccaaaaatctaacctaaaggcaacgcaatttttgtcctgagggaaccattctcaagtaacagtaacatgattttgaataggtcgtgtgacataccctgacatcttttcttgttgatttcaaaagacacaatcttcttctttcctgcaaaccaaaaataacaaaacagatcagagattttatcttcgcaagcatacatgacagagtgaatgagagagaaagggaagaccttgttggaaagcaaacggcaaaaaatcccttggtctaagcttctaatatgaaaaacgcagaaaaaatggaaatttatgagtggaaaagaacacaaatttatatgagtgaaaaattatatgctaaccttcagatttttagtgccgctgctgcgagatcgacagtgagaaagtgactgagagagtcgcaacggggagagcgagagagttgccgccgggaaagtaagaggccgagaaagcgaggaagagcgagggaagagttagagtaaaagtttcagaaaaaaaaggttctagggttttataaaagacatgtaaatttaaaattccacgacatcagttttcttccaaaaaccgatgttagtgatttttattttttgatggtaacatcggttttttaaaaaccgatgtagaatgtcttacaataacatcgatttttaataaaaccgatgtcgaatgtcttccagtaacatcggttttcataaaaccgatgttaacaacatccttttatttacaaaaatgccaccgcgttttcgttaacatcggttttataaaaaaccgatgttaaattggcgatgttaaaaggtttttttttagtagtgacggttttataaccgtctttgaaagtgattattttcgaagacactcaatacaaagacggttgtacaaccgtctttgtatggattgtagaaccgtttttgaaagacgcttttgtagtagtgcacacaacctcttttgggattcctttgtttacatttagggagaaaacttcttgtgtagacttccatagcgacatgatttggttgagggagaacaaatctgtccaatcatcatcctggaaaatcttattttattgagtattattattattctttcttaaaatatttcctttacttatgaaatcaatcttgcacttgacgacttacacttaaattattaataacgattcaattattatcattgttaacagattaaatataccaatttactaaatgattaacaatcatagttaaccaatcaacatgttaaccaataatgaacttatataaattgttcacacttcaaagtgtatgttgtcttctttataaagttttaaagatatagaaataacatactatatatatgtaaccatttcttttgaagaagtcgcgcggttacttaaaatatagtatttaaaaaaaaatcaaatctttctttaataaaagaagaaaaaatccttaacttttgtccaatcaatatttgtagtcaggaatcacgtggaggttttagcttcgccaaaacacaaagttacctcctctatgagaccaaagcatataattattcgtgaatcagcaccctaataacagagacacaatgtttgcacgaaaagaaagtaataaagcaaaaagagaaattaacaggaactagaatttgcgtgcaaaatgcataatatataagctcccatcaatgtgcatataaatgcacactgccagagctttcattctccaacaacggagacaacaagagaagtcaaaagcaaaagatcaacaagtaaaagtaactatggcacaggcacaatcagcagctaattttgattaccaagattttgatccctttttcgaatggtctgaagacgaaggaagtgtcacgctcattgtaatgcttccaggtaattatcttctttaattttaccctatatatatatccgtgaaaattaacctatagtaatactccatttaattattatataagcaaacaactgccttctattgtatgtgtcaactcagtgatctaattcgtataattcataaatttaatttttttgagaaaaaatcattcatgaaccctagaataaatattatatatatatatatattgtaaatagtttacatttgttattcaatatatattaagtttgttaatttttaaaacaaatgtatataaaatagattatgcactgataatataaaataattttaaattatcatttaatcataatttatcatatataataaattttataaattttacaataattcttttaaaagtcatatatcaattatcatttataattgtataacattataaaattattataaattatcaatgtataattattaaattcaaatcatatatcttaaaattcatactaatgcatgctaatttaaactttaaatcatatagtattttatttttcggattaaaaataatcatactttctcacaactaaggtcacattcacattttgttttatgtttatcaacacttcaaatttctctctttcaatcacatcataaactttattgtatttataattttttatttttaagtctctctctatatgtaaaatagtatgatggatgttcatcaaacatttttcatacatatatactttgaacatgaacaggattcacaaaggaacaactaagggttcaagtaacttcaactcctgtgctaaggatcaatggtgaacgacagatcgttgagaacaagcggcgtcgtttttctagagaattccccattcccccatattgtgacaccaatgatgtgagtgctaagtttgagggtggcatcctaagcatcaagtttcaaaagctcatcacccctgctgctaggtcactgccacaggaagctccaacaatgcctcagaaagaaaaagaaccatcacaacaacaagatcaggttcataagcaagagtcactacagaaagagaaagaaccaataactagtgatgagaaagaagagaacaaaacagaagagtcgtcaccacagaaagggaatgagccaattagtgatgatgacaaagaaaaggataacaaaacagaagaagtggttgctgaaaagaaggtgaggactaatggggtgccagagacagcaaaagaattaggaacaacaacaacaacctcatctaaaccaaagataacccagagactgaaaacaagggttttagatttcactgtgagtttgagatcagtagaagaccgggatgttgttaagcaagggtttggtggtaacaagtgtgcaaagctaattaagaggccaaagatatggatgaacatttttgtggtcatcttattggttatggtgctggggttgtatgtcaaaaatgctgcattcatgtcatctcataagggaggatcagaacttcaggaattcaaggaattttaattattcccatatatatatgcgtaatattcatgcatgtcaacgcatgattgaattcaatcaaggaataaaacaactggtctgatcattgaacaattggattcaaaataatagaccagttttccccatgtaattctttctttctttttgagaaaatttgaaaagaaaaaaaaaacacaatggtttatttgaataaaaattgtttaaattcttcatcagagtaatcagtactgcaatttactggcataacattaacagatgcaaaggatttgactcctacgactacttacatcagagtaatcacccttattattattttcacagttacttctatcacctttaatattttactaccattgttattatcaataccttggagatactctattttacgtattagtttagtcgaatattttcaaataacatttttataaattaaaaaaaaagtgtcctaaataaaataaaatttattcttcctctatatccacacactagttaaaatatttattaattttgtatgaataatctattatttgtgtttatgattttatttttattatattttattaatataaaatatactctatataaaaaaaatattatttaatattaagacgtatcggaaacatattaaaatattagtatttttgaagtaacgtattaacgtcccgtgtcgagaagtatcgaaaatgtggtgtcggtatcgatgcttcataggctgctaccaaagttttaaaacatgaatctttaatataatgaatatttaatctcttgaagaaaaatgtcttacattggaatacttttttatcatttttatttaatctatttataattaatgattttaattccttaattttttcaagtaaattaaatcattaattctatttttaaaattaagtgaatttaatcctacatgcatgttatcacttttcttttgtctaaaatctcattttataattaaaaatcttcacaaacagaatcaattatgttgttttaaatttttttctctccaaagtccaccaactaaaacattaaactttgacaaagataatctatcttttctctcttttacatcgtgtaaaacatttctgaatttcattaatttctaacttttaaaattttaaaatcatgtgatattctaaatttatcgtacaatcttaaatattttaatataaatataataattaaagactaatacaattatagtataactctaagaaaagaaaagactaaaaactaataatgtagttaacccatttttttatcttgtgaaacactgatatagaaattagaaagtgagacatggagacacgaattacacgagcgaattgaaaacctccgaatcagctaatagtatatcgagagatggaaaaaagctgtaattttttatttgtcggttaaagatttgcactcggaacaaatttttgcttttgggttttagcatcaccaaagaacggggtcacctcctctcgttactaaagcatattatttttcttgcgccacacaaactaatagtgtttgaacgtacgaaaagaaactaagaaagcaaacaaaatgctactacattttgcgtgcaaaatggtcctaattgcctcatcaatgatgagtataaaaagaagccctagaagcaattcaataccaagaagcaaatatacatcaaacgcaaaagcaaaagagaaacaaatcaaggataaaatcaaatgggttcaaggacacagccagcagcatctgatcgtgtctacgaagactttgtaccattgtatgaatgggatagaaatgaaagggttgtcaatgttatgctaccaggtaaatgttttttcaagttttcaaatctaacctagaggaataatatcaacttaattattagttcattgttataagttataacataagcaacagataaagaaattagttttgttttcatatatttttgtctttataggtaacgttcatcgtcaatctggtttttatatagaaaatactcaatttattctatatgtgtataaatatttccgaatttgctcaccttaattatttgttagtcgaacaatagaataaaattgatagagttattttttttcctacaaatgttagtttattattttttttctttcaaaatatcaattgaaaaatttgaatccacaatttctctctttcttttcttttcgttattatttaaccattaaatcaatcttatataactaattaatagagttgtttcagttaaaaatattgagaattatcacatctgaggatgaaaaaaaatagaggttgcattaatttactctaaataatgaattataatcagttactatccaaaatcatgatatcatcatgcatgatatatacatcttttttgcaatgaattaatctcaaactttttttaaaacatcatatcaacctaaaacttatgagaatatcttattatttcactgaaaagtcgtaaatctaataactgtggttaccaaaagaaataaagcctcttttgctattttcgtctaactttatgtatttgcaaaatcaaaaaagaaatacgcttcatctgctttcaatattattatcaccatatacaggttttagaagggatcaattgaaggttcaagtgacctcaaagcccaccctaaggctaatgggtgaacgactgatcactaacaacagatggcgtcgtttcaatctagaattgcctcttctttctgattatgacaccgacagtgtgactgccaagtttgagggtgctaagctatcaatcaaatttggagaactttcactgactaagcccaaggaaacattaacaacttccccatcacaaaaatttgaacagcaaaagccaacccaagaaggtaaagcagaagaagcaaagaccaatggtgaagtctatgatcgaaagacaccacagaataaggaggaaaccaacaaaactgaaacaaaaggtgctctggaagcaaagactgatgaaggctcaagtaaaacaaaagaagcaccaactcctactgctcctaagactaagcctgtttcaagaagcaaaacaaggctaatagatttcagcctcggttctggatcaaatcatgttgatggtgaagtcattgaagatttggaggcagggaagaacaagtgcaagaaattggtgaaatggatggtgataatctacttggttgtggcccttgtgggacttggggtttactatggcaaaaatgcattgacatcataccctgaagaatcatacttccaagagctgtgagattttcgccctcaagtactgctacttgtacaagtaaagagaagaacactttattcatttgcgtgtaaatgcatgaattcaataaaagaataaagtaaaaaatgtttgaggtttcacaactataatttgagctcattgagtcattgtatccgttgtatttctaatacattcatctacaattaaatgactcaaattctgcagtataatttcccgtagtgttgcttataaaatctatctaaagattcaggagcaaaggaagatgcaaatgaatggagatttatagagtatcctaaagctattgatgaaatgaaaaaaatatcaatcgtattaaaaaaaattgacacttatttttttcttaacacttcataattattgtccttaaaatagctactgtgtctaacacaaatgtggacatgatagtgatctttcaaaaatagtcttttaaatagtcaatttatcacatacaacaatgaaaaactctaccaagtctaatcctaatcctctgttaattaaataagaaaagcaatattcccaatataaaaatatagctacaaaattcaaaattattaaatgctcaatagatgggtccaacaatactagtacattcttagaaggataatgctcaccgactgaaaaccctctatatctctcaagaaaaacatatacaaagagaatgaaattgatgactacttcaaaactgcataaactccaattctgactaccttacattctttctaagtatattcttcagttagagacttaaaacaattatctcttcttcattcatactacattcacaagaaaataattatattttttttctctctttaaaatgcttgtgaagcctaaagaaatttttattttaaaaaatgatcgagttcaagtcaaaaaacttgcgaaaaaaaaaatacttcgaaagtggagattagaaatattctatctctcaattatagtaatagaaattgtctgtcaaggactcgatttatatttgaattgtggggtgaaacaatataaaattattgttttaatctttttctcccttacatctgtttatccgtttttctaatcaaaggagagattaatttgttcaaatttattttttttgaaaaaagagattttcttaaaaattattttcactgtgtcattggtcttaagacaatattctttcatcccagactaacctttctttgcatagatttgtttttcttcaaggtcttttttttaataaaatcatgtgatcaatcaaattgcttttataaagattacaaaacaaaattcaattctccttctggtgttttttatttgtcttttacatcatcttacagtttaattaggattttcacccttcacagttttacttttatgataaaatataaagataaacttttcgagcattgaatgataactgcactattccgtacgtattcctcgaatttgaacacgggggcaaaatgttgaaggcaaagccgagaagaaaatatactaattaacttcacttgcaacaggaacaagagacatcagagtcaacaccagtggctagcatataactctgttcccacacatctgcaggaactgcttcggcatgaggaacgtgacgaggatgtttttctctcttgtctcccctgagctgcttcagaccacgcttaagtgctggcaataaagcttccatacactcagcaacagcatttgggtttccatgcatgttaatgatctgaatttcaacaaatcaaggaccataaagcaatttagtaacaaaagtaatttcaatcttaaagattaaagctactgtaaaattggcgttctcaattcccgataacagtgccaaaaacttgttgcgaaacggcaaatgcacctttcgtttcaaataataaagtgagtaagtagagtatcgtctccacagggattgagatacaaattttatcgcaacttattatcttaagattggaagataatatttatgaaaagaatatgattgaattttagaattacgaaaattaaataactgaatagaaaattaacgagaattcaaaaagaagttttaattaaatgttacgcagtattgagaaataattgtggtcagagcacctctacttctgatccctatcttctatatacaaattggtgattgatttcaattgttataattgctcagaggatgtatttgatataatttagttaaatcataatcccttagtaatttaaccctttaacccaattagaaatcttaattccttagtaattctttattaagttaagcattaggaaaatacatcaattattctataattgtccatccctatccctaagtaatgtaacaattatcaattattattctaccgctatcagaaatcagagttccaacatccctattgtaaaccctaacccttagaaccctaatagagtgatcaattctattgaagcgaaggcaatataagcgcaagatagaataaaacaatcataacattaatctcaataccaatttaatacagaggagttcacatcagttttttgctctaaccacaataaggaaaattagccagacatgctcataactaaccttcattgcaaaactaacatgtatctaagagagaattataagaaatagaagaattataagctgctccgtcttccttcaatcttctctttgcgtttatccttgtgtttctgtgtttttccactgtccaaaagtgtcttttatttatttttccacgtccatatagttaattaggtcactaaaccctttctggcgttctatttccatgccaaatcacttaaatctggaagttgcgtgtttttggcgctactagcgtgaacctggcgctattggcgtggctcttcagaggaaaataaggcttctctgattaatggcgctaacagcgtgggatatcatgctaatagcgtgagatcacagtggagaacaggtccttcaagcagctggtgccaatagcgtgaagctggcgcgactaacgtgggcaggcagagagcacttgttacctcctgttgcttcttttcctctctttttgattcctaaacaacaaagtatgaataaaataggtaataaaccaagaattgatgacacttacctcattctatcctatattaataatttatgattgaattattgatcaatttaacctaaaaactattgtatgctagcagcatatcagctgcttcagaccatgcttaagtgctggcaataaagcttccatacactcagcaacagcatttgggtttccatgcatgttaatgatctgaatttcaacaaatcaaggaccataacttagccgataaatacaagtctagaagaaagacagattacatatccggatctaggttgtactagttacaacaataaatgcaagattttccttaactactcatgatacagccccaatgcagcaccattttagagccaagggcacttgtataccataagtaaatggatgaaacttaagtaactagtaataaaaacaaattatcaaataaaagaagctttggaatctatatgatttgagttttctgaaaatagtaactgtttaactaaaagaatcatgctgtaaccatgaagattgaatacaataggtaccttcaaactcaaataactaaaatctagcaacagtacaagacatggacgttttatccctcctaatattctttttgataaaccagcagagttttaatcatacgaaatgtgttggtaatataatcaattttcttgttttcttattatttctaaaagaacacttgttatttcttgtcatcaccctcggttaattaatttatgactaaaaagactttctaactgttttaacaaaccattttttctgccatccaataacagataattactttctcattggttgttactgataggatattgtacaagtgggagaataagatattttcctagaacagcccataaaaagaaaaagagaaccacgcaaaaccatcaaagaacattttaacaataaaatcaaccattgttaaaaaaaatggggcatagccacttccttgcatggtgatttgggtaaattttggtaaagagtttcaaacttctcaacttattcattaggcagtgcacaaacagctaattgagaaagacagagaatgaagaataaataagacaacaaaaaatgtataatcctattacagcataaaatactataaaactataaaccccatgtgttatacaaaggatgcgtgaaaaatcaataatatgaagcctcagccagatacaatgtacataagtttctgcagtcaacagaacactcaacactactacactacaacagagcaatgcccaaaacagagtttttatcttccaaacacttcaacaatgagactgttgcaaaacactcagtacatccaatgccccttttggcatcgactaatatcaagttcgctttttagtttagcatcaaacttgtgacctctttcaaacaatgattcaaagaggtgtatctagatgccattcagcattatccaactaggaagatgatttaccaataatgcaacattggctaatttgactatttcaacacatacgaatcctgttgcagatgagcatagctaaatctagctttagtggtaacaaatgccacattgctcggttcctttagtatccacagaaaaattttctttggtttggaagagtatactagatgcactcgattaacaacaaaaattcctatttaactttggaggccaagcaagaaaaaacatgatgaatatgaccaatacctcattaaccttgtctagagtattgttagtaccagtttcaggaagtaaaaaaaaaaaggtgcagtgtggagtttctgcttctgcaagatttcattagtagaagctgctttatctagaaagtacaaaaactacttaagtcttaaacattccacacaaattgatcaaataccagaaaaatcaattaaagtgctcccgtcattcaaaacagaaatccaaataggctaaaaaaatgctttaatcctgattttcaactctatgtatgtctccttgtttgcattcaccagtatataatataaaatgaagaccaataccttcgatctgggccagcacccgtagcaactgtatcactaactgtaagaatagccactctgacttcagcatcccctgaagaatcagtagttactttatgtgatttaattccaggcaaagcaaaggctgagtctgatgacttatgattctcatcacatgccatgggtcttaggtcacaaattatgatagattacacagcggtccctgcagaaactacactgcctgttgctggaaactccaacaaggcattagctgacttcatactaagtagtcggctgctcacttgatgaccagtgctcacagcaaaaaaactgcaattcgtggacaggataaaaaattcattcattaaagagaccagatcaaattagcaacagtgctcggccctccgcataatacccacctcttcctccccacaaaaaaaaaatgaaaagacatgcaaaagaacaaaacaagaacaaaacaattcgtcgtcaacttaccctggattgcatgttccatcattgtcagcccatataacagaagcacgatgatattctggctaactggatctgtctttgtgagttgacaaagccgagcttgtgccctgcatacaaaagaaactaaatgaatcaaaaccataaaaagcaaactatcttaaaaacaattgtactttggaaatttacgtaacctcaaatgctggtattaaagtagaaaaataaaaagagagatgtagaattgtctaagattttttacatattcagtatgtttatcatttttaaagaaattaaattaaaaaaaaaaacatttttgacagacaaattatcacaaattgtaatatcacgaagaataagaaagattaaaaaagtgacttttaaaaaatttgaggaaccagtaaattaaattaaaaaaacattttgacagtgagaaattattaaaaattgtgatatcattaacaccaataataagaaggactaaaagtgacttttaaaaaatttgaggaaccagtaaaaataaattcttttttaaaaaactaaaacaataattatctaaagttaaaggacaaaaacatatttaagttaaataaataacatttcctctcggatgaacctatccataaaccttaaaaaaaaataagaaaatgaaatcaacttgtctcgtaaactaaaattgatttatgtaattgatttatacagaaaaatcctcgtctaatttctctaaaaactataatgcgtaagttgattttaaacatcacggagaagtttatcctcaatgaaagtggaatggggaaaatgagaagtggaaaagcgaaactctggttgttacgtgagcgacagttccagggtagagagtgatgccgagagcgtcatctcctgctcttgattcggcaacgacgggatactcgccggggccatcggcggcgacaacggcgtaactttccttgacggaggccgggtacggcgggagagggtcgggagcgcggacgtcttgcgccaagaccttggcaagggcttggggaaggggaacagtgagtgggagaagacgtttagaggggccgtgtcacgtgtgagttgtgacagtctactcaatgtataagttgaactttaatccaataatatttaggataaataattattttcttttctaatggtgtaaaatactgataaaatttgtaaaataaaaatttaaatttttatttagtgaaaaagaatttgaaaaatttatctctttattaatttttatttgttattattaatatttatgaataaatttctaaatgtattacatattcataaacaaatttatgagttctttatctaaaatataatttaatcttcatattctcttttttttaatcattataaatataacattataataaatatttaaaaataaataaaataaatataacttaaaataaacataataataagtataatattaattaataaacattatttgtttgttattctcaaatttttattataacaacattagataataacaaaatcaaattaaatttcattttttatgtaagaattaacttaatgactatatatttttgtttgaggtgaaacttaatgaaaattaaaataaacatattttgtaatgactaaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgaaattgtcaaattttctacacatttaaagattaaatcaaatattttctatattttttctctcaatgttaatcttcttgtcaactaccgacttgaatgaataacattcgcaatcggtaatttgctacattaccaacaagtctgatgtggtagagactcgtgattttcttataaactatgttttaatctaaatatgtttgtgattttataaagttgaagggtgaaattaaaaaaaaaatcatcaatctatggattttaaaactaccgagaatttattacattcatttcctcacaagacagtttttattctttgaaacacattgtggaacacaattatttttagataacataaaaaaaagaagaacggaagacacaattttttaaatatatatttttattattaattaaaatttattaaaattataaaattatatgagtatatatgatattcaatgaatatctcttatgatattgtaattttctataaatataaatgaataaaacaattatatttgaaagaatatatctaacttgtaagtaaaataacatgaatttcattcttttaatctaatttttaatttatcaaaagaaaaattaatttcttacataataaattgatattttctttcctctgtttcaaaataatttgcattctaaatggatcaacccaactcaagatttttttataaaagattaataattttataaaattaaccatccataacacttctccagctccacgttagtataccgcacaaacattctagaaaatttccaattcagggggcagcaatgatattccccaccccctgacgtcaacgttacctgaaaaccgtgacgcaccccgtggcgtcgtctttattccgttctccgcccaacgcaccacctctcctttctcctctccccaaaatttaaaataaaaatttcaaattccaaatacctcagattcgcaaaaatcccttctccgtcgccacatcgcatgaaccttgaattccgatttggataggcatgtctggagcggcgttatcgccgccgacgagttcgaagtcggtgatgcagacggtgaacggttcgcacaagttcgtgatcgaggggtattcgctggcgaaagggatgggagtggggaagcacattgcgagcgacgtgttcacggtgggaggttaccactgggcgatctacttctaccccgacggcaagaatcccgaggacaattccgcctacgtctccgtcttcatcgccttggccagcgaaggcaccgacgtcagggcgctcttcgagctcactctccttgaccagagcggccaggggaagcacaagcttcatagccatttcgatcgctccctcgagaccggtccctacacgctcaagtacaagggaagcatgtggtacgctttcaccatgctctgctgccaataacctttctttatctgttttggtgccttcatgttttttttttttatcttgattgtgcctctatgttttgaatgtttgtagtttaaagttttaatgatcattagaccgtggtttttcaataatataaagagaaaggacaaaatttagatgcagttcgataggtgcttttggtgtttttctcctattacaattgaagtttcactctgggaatcctgcattggcatttagtggaaacctttattagacgaattaccgaagtgaaacttcaatttcttattggaggacaacaccaaaagtagcacatatggaactgtatctaagttttccttctcgcgtactatgaaattgtcattgttatgtacatcaatttactgaaactccatgtgattttttcttttggaagtcgtaatttatcttcttttttactttgagcaaatcatactaacactccctgaggtttcttgacattgtgcatgactacttgatttattcatgtttatagcaaccctttataggggtagatggtgtaatgtatgtgtgtttgtgacaagaggtgttagtgtaatgtttttcataccattaagtggatcggtgtaaccgtgtaagggtaaaaaaaggagacatattgggggaaatttgtcgaaatctcaaagagtgttaggataatttgttccttatctttttattgatcatgcttgatcatgtccttgtaattagcttaccaaaaaggttatacaggtcagttagctttccagttcttatgttttttaatggtttatataaagatttgtattgtcatattatgcatgaaggtttcacaagcaaaaaagatcttctctcttttaaagggttattgatgtgttcctgtttttgatttctgtccctggttatctctcccaggctctccttatatggaaaattgatgctagatcagtctgaaagtatgctgttcagatgttgtgtcaacatgtgtaaaatcttgatctcttttttgtgcttttataggggctacaagcggtttttcagacggtctttgcttgaaacctctgatttcctcaagaatgattgtttaaaaatcaactgtacagttggagttgtggtttcagcaattgattgcccacaactttactctattaacatcccggaatctgacattggatcacactttggtgcactattggataatatggaaggttcagatattacttttgatgtagctggggaaaagttccctgctcataagttgatgttggctgccagatccccagaatttcgatctaaattttttaatggtttagatgaggaaaagaatgagattattgtaacagatttagaaccaaaggtttttaaggtaaaaactatttgtttcccctttccttattttccttccctggtagcatcaagcttgttcaggatttattttgttattgtatatttttctgttagctttctttttcttgatagaaaaaggatcttataggagttcaagagttaaagtacaactagagaggatggatatcctgattattcctcttttacaggccatgctgtactttatctacaaagatactcttacagaagaggtgggcacggtttcatcaaccacaactagcaattttccggtttctgagacattgatagcaaaattgttagctgcagccgacaagtatggcttgggtaggcttagattgatgtgtgaatcctgtctttgtaaggacatttgtgtgaattctgtagccaatattttaaccttggctgatcattgccatgcctcggagttgaaagctgtttgcctaaaatttgctgctcaaaatctagcaggtatacttaatttgtattactttcttagttagcaatggcaatcgtgctaacagaaagactgatgttttctgtttaacttttgttgttaacaagtgactaaaaaatgtaaaagaaaaatgagttcagatacatgcatcctgtgctaactaaacacagctgtctggcatacacaactagataccaagcagaaaagatagatgttatagataggcctattttgggtaagatcctgtataaacacttgtaggagaagaaaataagaaagaaaaataaaataagtttctcctcagctaaaattagtttatgcataaatactagtggagaacaaaataaaatttcttgacttcaggcatactaaattacaatcttgctttatcttccaacttttctcattcttgatatgatggctctttttgcgtctggacttgttgcagctgtcatgagatcagatggatttgagcatatgaaagaaaaagggccatggctacaatcagagatcctgaagacaattgctgggtgtgaaggtgagggttgcagtgcagtggaaaaatctcagagtgtatggggccaactttcagatggtggtgacaagaatggtagaagggtcaggcagagaatctgatatatgttgtcacactggtatctctctgattcttttgtaaaatgtaggtgataatgctgaaaatttggggggtaaaaaagaaaacagcaaagaagagggaaaaccctcttctgttcaacttttccatgtttaaatggaaagtttagaaaaagcaggtagactaaatgttatgcaggtttttttttttttttttaatgtaaatgtcatcagtgggtgtatgttgttagtgcagaatggtaattgaaaatgagcttatctgcagtagactattgatactgactatactttggaagtggatatttggttgctggactttatctcttccatttgctttctccttttctgtactcggttccaaccgaatgtttgtagaagtaggttcattaggatggctgttgttatacaacttcaacattaacattacaatacctttaaccccatgctaattggggtcggtggtagatgactcaatgatagatatgagaaggttgaaaaaaaaaagtggaaggtgaaggagaagggaaagggaaataatataaaagaaaaaaaaaagagggaaagaaggagatgggagatgaagaggaaaaagactaaaaaaagatcatctagaacatagagataacaacgggtgtaacccttcaccaagcttataatttttctctatttcgtcctaagacacaccatccgtcaatctatatctcactctattaaatcttgtttaactacattttcccaagtaagtttcggtctacctctatctctcttttttggtaacaaacttttgttcttacgggaacatccagggaacgtctcattacgtgccaaaaccacctcaatctatgtttccttatcctttcactcaccggtattactgttacctttcttcgaatatcttcatttattattttattcatcttggtataatcacacattaaccttaacatcctcatttctgctatccctattttatgctcattctatctatgtgctggccaacatttagctccatataacatggatgtcttacacttgttctatagaaattttcttttagcttaagaaaaattttgcggtcacacaaaaatccagatgcactctgccatttcatccaccctgctctgattctatgatttacatctccatcaatttctccacctttttgcaaaattgattctaggtatctagaaacatatttctttggtacctctggaccaaataaatgcacgggatcttgatcaccatctcttaccagcgaaaatccacacttcatatactcagtcttgttccaacttaacgtgaatcctttagactccaaagtgtttctccacagttcaagtttcctattaacaccatctttggtcttatcagtaagaataatatcatctgcaaaaaaacatatacaacggtacttccttttgaatattttttgttagttcatctatcattaaggcaaatagataagaactaagagccgaaccttggtgtacatctaccgtaataagaaaataacttgatgtttcattaaaagctttcacacatgtggtagtcccatcatacatatctttaattgcatttagatactttaatggtattttttttcttcttgagagtccaccataaaacttttcttgggatcctatcttatgttttctcaagatctatgaacacatatgtaagtctttcttcttttctcgatattgttacattaatcgtcgtataaaaaaatagttttcatgtgacataaatccaaattgatttaaaaaaattttagtctctctcctcaagcgatatttaataactctctcacacaactagtatggctcataagcttaatgtctctatagtcagaacaattatgaatatctcccttatttttgtaaataggcataaacatatttttcctccaaacatcagacatcttatttgtttgaagaatcttattaaaaagattggtcagttattttattgtcacattcccaaggtctctccacactttaatagggacgtcatcgagtcctaaaactttattatttttcatcatctttaaagtctcattaacttcatgtgtattaattctgcgcacaaatcttttgtttagatcatcataagcgttctccaagtcgacctcacttttgtctccacctccattaaaaagtttgttaaagtagttcattcatatttcatttacatcttcgtttcttaccaaaaaaatttattttcattcttgatgcatctaacttgagtgaggtattttctcttttaatccctcatttttgtaatttttatatacttttttttactatccttgctcccaaggtttttatacaaatcggcaaaaaccttgtcccagcttcccgcattgcattctttgcttttttctcgctaatctaaacctttgcaagttttcatcattgagatttttatgcaaagatgtaaaacattcattcttctgtttaattgtcttctgccctctccattccaccaccatgttttctttgtaagaaatatgttttttttgctttctctcaacacctttctttccatattttggatacacatagtcatctcattccatatttcatttgtttctcttacagactaccacgatccttcacgcaacatgctttctttgaactctatttgtttttgtttttcctcatttagcttccataatcttataattgggttttgagtcatcttcctcttttaagtactttgttgaatcgaacctctagaactaccaatttatgtggcgtagcgacacactctccatgatagaccttgcagtcaatacaagaatttttatattctcttctaactataaagaaatcattttgactacgattttggttattatggaaagttataagatgagactccattttttcggaaaaaagtgttcgctagtatcaaatcgtaggctagtgcaacgttcaagatatattctctagtctcatttttcgtaccataaccaaaacctccatgaattttatcaaaacctgcattgcttttaccaacatgatcatttaattctctttttagagaaatcttctctcatggtatttctctcaaaatctcttctaagtcttctcaaaattggttcttatcaattatagtccaaattgggatgcatacacattaaagatatttaaaattaaacccctcactacaaatttgatcataatctttttgttaccttttcttttgttataccatgtacaaaatattcattttgtaacaattgtgttttcatggcacaccttcaaaggagcttcgactcagttacaccagtcatgccaaagaaacgtaaaataatacgggtcccctaaatcctaatatactaataattagcaccacctctcttttttggtaatgtttcgttaagaaaatctgaaatttgaggagttgagggaatacaatgttggttcggtgatgatacccacaatttgttacaccatatattacagttgtgatgaaaatcagaaacacattcattatcgaatcaaacattaagattttatagtttcttgaaaatattaacccaaaatataattcttacattttaattctgttaacttatatttaatattcttcgacaatcaaatttattatataagaagtgaaattctcataagaattccacgagtctaaaaaaatcaattaccaattaaaaaatgtattcgaaagatgttaatgtgttactaacattctaaagaaaagatcattagtacgaagaactcaattaacaaataacaggaattttaatgcaaagaaattttatgaaaacttaacttttatttcaaccatcatgtatgtttaataattttttagttgataaaatttcattccttacttttcatattattcgtacctaagaactttcttgtaaattgtatatccttttatttttttggttgaatcattgtatgtatttttttcaacaagaattcaaatattaatttgtcatgttatagattactagactcaattcctattggtaaatatcttgaaatacaaaacatatatatatatatatatatataactcttaattacacaagtatagctaacggaatttaagattagtagaatggattaatttttcacattatgataaattaaggttcaaactccactaaaagggatacttacctttaggctttgtttatgagttaggagggaaggaaatgaaagagattgaaggagaagggaggggaaggaaaggaagaaaaatgagggaagttccttcctccttgtttgggagttaaaaatatattaagagagaaatagagagttaataagatattaaatgtgaaaattataatttaaatgtaaaaatatattaaaaatatattttaatatatttttgaatgtgtagttgggataggataataattttaattacttttccttttaaaaattcccaaattggaggaactacaatttgtaggttttggaggatttcagagttttaaaaatcctcaaatcctttccctcaaaattaaaactctcaaataaggagatgtctctacctaaacctttcacttccctcccttcccctctaaaattcctctctcaaacaaaaccttagtgttcaacgatatctcgaaaagaaccttctagtaggttacatatatattggggaaattatacaagtacaatattttagccaaaaagttttgataaaaatgaagttacacacattttaaaatactaagatgaagtattaaaatgaatgggctcaaatactaagcccaaagccaatcccacgttttatttcatttcaaccgttgtcatttggttgaaacaataggtcaatagcattagcatagcatcccacaaaacctgaaaacctagcagaagcaagtgcaccggaaacaaagcagaaagcttgcaccggaaacaaagcagaaagcagcgatggaaaaccactcagatgaggagaatggcgtagcagaagaacctcaagcacttgaacagaaggagaagcgaaaggggaagcacgacaagccgaagccatgggacgacgacccaaacatcgaccactggaagatcgagaagttcgacccttcgtggaacgacggcggcatgctcgaagtgagctccttctccactctcttccctcagtaccgcgaaaagtacctccaagaagcttggcccatggtcaaatcctctctcaaggaattcggtgttgcttgcgaactcaacctcgtaactaccttcctctgttactcattctcttttttcctcctctagtttcaatccaaaaccctaatttcgccttcgattgtgacaatgcacaggttgagggttccatgactgtttcaaccaccaggaagactagggacccctatattatcatcaaagccagggatcttatcaagcttctatcacgaagtattcctgctcctcaggtaggtaggggtgtgtgtgtgtgtgtgtgtgtgacttctttctgttttttttataaataaaaaattcagtcatgttaatgttatttatgttgctatgattgttctcaggcgataaaaatacttgacgatgagacgcaatgtgacatcattaaaatcagcggcatggttcgtaataaggtattttctccgaagattttgcaaatgttttactgcgtgttcttcttgattgctgtgtgcctctatggttttgttttgttttatctttgaatatctattagcaatgatgcctctgccagttctatagtgctgctactgcgtgtgattgactaccctcatgataatggtcacttggtcaggaattgtatgcactgctgacaagatttgtggagcaataatcattcgtcttagtatacatgggaactgagatttagacgcaattatgacagttatttgtagaaaataactgatagtagttatgtatcaggagtatatatctgacagtaggtagtgtcaagttattttcagtttgttgaaagagaatactgagacttctgtctctgggacagcaagggtgtggctgtatttgtgtaacagtggacttttgtttctggggcagcaagtgtattgccatgttgtgtgtgatttcagtgttcaatataataatttattactttattaattggtgttctattaccttccaccagagtaatacaaatagaattcataagctatttttggttaagctttattgaattgcacccccaaagtcctctctttagctgctaaaaaaattcacattaaaataatttgaactgaacacgcacacttcaagctttccattgcaatgaaattaactaagcactttcaggagaccttctttagtaacattccagaaatttgaaaccatcgggctgccatggaagttattttttccccttatccttacttgaactgctcttttgattttgtattctaccatatgatttttgtattttgtcataatactttatgcaacttaagcatttcaaagaaattagtctgatggtaggaagttcccttgattttctgactgcaggagcgatttgtaaaaagaaggcaacatcttgtgggccccaattcttccaccttgaaggtgtgctttttgtgaagattttattttttcagcatttgtgggataaaccctttgttgttactttcttgctttggttttctggtactgcttaccaccaattgttggcttcaactttgtgactcacctttctccaactataatactggcttgcaggctcttgaaatactcactggctgctacattctcgtccaagtaagtttgacttacgcttcatagtttagaatgtgaagactgtacatttactttcactatgatatgagtgtagtctagaatcagctgatttctttttaattttgcacgcaattccacagggaaacacggttgctgctatgggttcattcaaaggcttgaagcaagtcagaagaattgttgaagaatgcatgctgaataaaatgcatcctgtatacaacattaaggttatttaatttgtattttatccagcttggctttgtggtatagattttgggcgtagaaaatatctcaattcttcttttcacattgtcaggttcttatgatgaagaaagaacttgaaaaggatccagcacttgcccaggagaactgggatagattccttccaaaattcaagaagtatgccttttatttatttgataaattgtatattcaaggtactcacccaccctctgcttcagtttcattgatgcttcatatctttttgtaggaaaaatgttaagcaaaagaaggttaacactaaacagaagaaaccatacactcctttccctccacctcaacagcccagtaaggtaagacaacctctaattaatatctctgatcaagctggatttcttccactaatgtacagagtctcctctactcatgtccccaacaacaacaaagtaaataattgactagcaaaaatatgtatgttattatgtattatatatatatatatatatatatatatatatatatatataagtagtaccagtagtactattatctgtacatccgattgtgccaattatcaaagtaagattatggtatggaaattttctatgaatattagaataccataaggcccaaccctaggcacacaggaatacccattacaaaagtgtctatggcctaatccctcccctatacaaaaatccagatttaatattactagcccaaaagtggaatggcagctcaaaatcattctctaaatatctaagccacatccagcagaagaaaattgcatcctccatcaatttctgtccattaaactcctcatttgagaaaacaattctgtttctgagattccaaatgcaccatgtgagagcaacccaccaaatccgccagctgttatggctagtcttttgattcttttgattgcactgtcacccagacttcttcctgtagctccttcctcagcctgatttctttctcattcgaatccctttcttccccttccttgttctgtattgtagtaggacccgactgagcccacctgcattttctggctatgttgtaattagtgtttaagcatttgctttcctatcatagtttctggtaattgctattgattttttaaagtaaaaaccttgtattttgtatctaactgatattttgaggggtatcaccttccactttaatttgtggcaatagacatacataggtgattgattgtgaaagatgattaagattcaactttgaggtttatcttcaggagttgatatggtccccttgtgggtatcttaggtacttttttttgggtttctatcataatgagtgtatcagacttagctcaagtgtgcattatctaggagcaatttgtgaatatatgaacttcatcttggcctttaaatgagaatgacaacaccaattccacaactacttgctgccctctgcttatattggcttttttcttttatttcccccctggggtagtgtatctgtattatatctaagtttttgacaaactatgttgttctggtactttgttaatctatgaaataaattttaagatgtctttggtaatttatgtgacatttcagattgatatacaattagaaactggagaatactttttaagtaacaaaaagaaatcagcaaagatatggcaagagaagcaggagaagcaggctgagaaaactgctgaaaacaaaaggaaaagagaagaggcctttatcccacccaaggtttatattgttatttcttttgcgattttctctactattcacaacaatttatgtcgtgcgtactattttacagttttttttcaaaacttttatttgcactctttactttaggagcctgcaaatctggtggataaatctgaggatgctaacaataatgtagctaacatggcaatgtccttaaaggtaaacaagtttctggcggaactttattaagaattttttctctttcttgtttgaccagttagaattgttggtttctttgcctaactggtattttctcttaaataaatcatcatctcacttaaattcaaaatggttcgtccgcagaaaaaaacagagaagtttgggaagcgtaaatctgaagaaaatataagtgccgagacatatattgtaggatcatcagaacaagcatcgggaaagaaacccaagaagcaaaggtcttaaacataatcttcattttggagacgaaagatgagcatgtgatttggatgtgaatttaatcaagatcttctgtatccaatgtcttggccgtaacagttttgacaccattgtatgaggcatagttgttcattccatttgtcgtggagatgagtgcgtggcatttttgtatcttattgtacttgccaatagacattaagtcagtaacatgtacaacacttctagtccttttaagttttacatcttttccttttcaaaaacattgtccgacacacatgttgatactatatctatagttttgacaatgtgatttatttgttaaatttggtctagtctcaaaaataaaagggaaaaagaatcagaaacacatttattcgagtttgccacttaagttgtttttaacgaaaccaaaatgaagtcacaaaatcagtaacgtatatggatattcttctaattttcctttcgtaagtttaataaatttatagatccctactaccatagttttaaagatcgaaatagttaatgcgacatacttaaagcattggatcaatggttgtcaataaataactaatttacttgcatgatcctgtctgtataaaaataatataaaaaaattatacatttattaaaaagtttcaaaaaaaatcactactcataaacataataaagtgtcaagtacctaaagttattaagcatagacattttttaaacacaacaaattgaggtagtactgaaaacaaatcaataatcacattacaagaaagttgtgtcattttgagtcattttaaagcaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgaacgaaaactgatttaaccataatatgttagaatgttaattacaattaattgattattaaatttttggttgccccacccattatctacaggaactgaaacataggcggtctaatcgtagaaagaataactctgatagcagagatcgaaacataaaatctccaagccataattcgggtgcatcaaatataaaggcagttgagaatattggtggaaacagtgttgaagagtctggaagctataattctcgaaggaaacaaaaagtttttcacaagcaaccatcttcccttaagcagcggtttttctcaagtaattttagaaatcatggaactggtcgaaactctcacggaatcatatctgaaagcccgcctagtaattcggttgggtttttctttgcttctacgcctcctgaaaatcacaggtcagttcaaaattattgttcccagtgctaatgactgtaatattggtttgcttagccagccttttttttttttttcacttttatcctttactggaagaatatatagtaaataatttgttaaattaagaatataaattattactgtttcagagagtatgatatgacatgttgattgtttggtttgacaactgaagctatttccattaattatcttaaatttgcagtttcaagccttccaaattgagtagttctataggatttgcttttagaagaaaacggtttcaaacaacagaagtaaatgataatgcatactggttgtatgcatgagagtggtactaggatatagtcctataggatttgctttttaaaaattcctcatgttagtattcttcctttcaggtacttgaagtatcacaaacggtgcctgaatgatagaaagaaacttggaattggttgcagcgaggtgaactccatttcttacgtttctatgaaaaaatatttgtaaagaaccacattggtagcccaccgattgaactcattctcaatttctgttcctgttacttttattgtgcatcatgcaccgaaagttgaatatattgcctgccttttttattacttaatttgttaattgaatgacttatcttctaaagtactttgtgtacgagtatgttgcaatagttcgagtgaaaattgtggaatagttacgacacgtggtattttcaatattggtttgcattggtcaactttctctttttaacttaacaatgtcattagccgaagctttcatatcaaaatgagcctggatgcagtgctgccatcttcattagctcactttgtatattatgcattcatatttttttttatacatttcggttttcatattatttgcaaatttaatatttttgtattatattctttttcaatcatacacttgcttattctggtaggtttttctttctcctccttttgtgtgtcaatgcaggaaatgaatacattatacagattctggtcctattttcttcgagacatgtttgtgccttctatgtataatgaatttaagaaattagctaaggaagatgccgcggctaattataattatggtatagagtgccttttcagattttacaggtaccatttccaattctgtcttttctcatttgtttgagaagatagaaccatgatttagatttcatcttttgctccattttgttgagtaaagtaataggctaatttcaagtcttctgaattttcatctattgtttctttggagaagctgattaaattgctttatgttgtctatttttatttttatttttccttagaagacatccaagcatagttcttctaatttttgaatgattttttgctcagttatggattggagaaggaatttagagatgatttatacgatgattttgaacaactcactatggatttctaccataagggcaatctgtatggcctggaaaaatattggtaaaaaaccaaattctcttgcttcttatattctactgcatattttctgttttgtagtttcattccttttcccaatttcatgtgagatttgttatagtgaaagaagtaaacatattggttggttagtgtataacctaagttgtattctagattaaaaagattgttcactggtctatgaaatctaattatacagtaccttagttatatttgattatttctgtttgtctgacttgtttgtgtcacaaaatctttataacatagtttctgactgcattattggactgaaatggagcattttgtttattcttgatggtagatttgtggaacagtatgagcagttctaaatgttaagaatgtgcatgttataacactactcacctatgcttagctaatccaaaatagatcatcatattggaaatatgttagtttctatgtcaaatgctagcatactattttattaatattgcatttctatatttttgggtgaatggaggttgccatattctaaggcaaggcactgtctccctcatatctgttggatatagagaaatgtagttttcttctgttgttttggcactcctcttcaccatattatcactctctagaacttttgttcttacatatttatatttatatttatggcattggcagggcatttcatcattaccgcaaggtccgtggccagaaagaaccgttgaatcaacaccctgaactggacaggttgcttcgagaagagtatcctagattggaggatttccgtgccaaagaaaagagtatggtaaaagaggatgtcaattaagttgagtgatatgtccaaatggtaaatacaaatggcagagttttgatggcatccccaattttgatgagaactcttaacaacataacaatgagttgttgtggagtagcggcctactttttgaaagaagattgtttgtttcttctctatatttggttgagttgattatgcctcatcaagaggattgctgatagccaagtcttttcaggtttctttgatggatcattctatatggtatataccactgcatcctttctttggtgaatcttgcaaacattgagagacacattttcttttctccaaatgttgtacataagttgatagactagaagttgtgacgttacagcataagaaaaagaggttcttgtttttatttttggtgggggttaaaagggggaaaagggttgtacttatatctttgccaaatttgaacaataagagtgagaatcttcttactttgtaacttggcgtgctcatttaatttatatgtaacaattattgtcttaccaaagtgttattggtatggtttataaagcaaaatgtttttggtacgactaaaatgggactagttgtctcttttaattttgggagagtatttttggaatgattgtctgtgaaaaagataaaagtcaaggtaaaacaattatatgcggtgtaagatgaaatgaatttaaattatttgatgtttcttcatcatcatcaacatcacatttaacctaagttaattggaatcggtggtagatgaactcaatattagatatgaaaaagttaaaaaaaaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatattagttaaaatttattaaaacctataaaattgaaaaaaagtttttaaatgagaagtaggatcataaaatttgtgacctctaataaattttaactaataataaatattgtgtttaaaataactttttaaaaatgtattactataatttctcatttatttggataagtaaatttattatgattaataattttgaaatctttgggtaagcaactttgaaagaattttttttttttttcaaattttaaagaataacgagtgtcacttgggcgccaaattttagcgcgtcatgctttgttaaataagaagccctgtcaacggaaagaaaggcaatttgagtttgaagcttcaaactttgaaagccataaaagaagaaaacaatgtctgagttctataataacgattggaatgatgatgtttatgactacaatctgctttttgattgcgatgatatatggtcgacgctgaactttgctacccagattcctatggcggaggacacccaacaccaccacacaccgctgaacgttgcaaccctagttgcggaggacacccaacaccaccagacaccgctgaacgttgctacccaggttgcggaggacacccaacaccaccgcacaccgctgaacgttgctaccctggttgcggaggacacccaacaccaccagacaccgctgaacgttgcaaccctagttgcggaggacacccaacaccaccagacattgcccaatcacgtgaaccagattgcgtgggctccggtcgagttgcccagccacccagttgaggcgctggtgcataacggtggtggttccatgatgcagaacgctggttcatcggttcggcgcaagcaagggagaaggaatacatggactgaagaagaacataggtaggtttttaatatattgtatagaaatcaaatgaatggaagtttctcgatttttcctctcatgatcatatttgttttttaatggcaggttgtttttacttgggctccaaaaacatgggaagggaaactggatagaaatatcaaggttggttaaaacaagatcccctactcaaattgccagtcatgcccaaaagtatttcattcgccaaaatgcctcacccatgcagaaaaaaagaaaaagcattcatgataaaaacttacattacacgaatggagttcctcacatcattgatcctcaaaattcaattcctcttactggaattcaacaagttcacgaaatgcaacaaaaaaaacaaaagttgccgctgaatccaccaaatagcgtgactcatcaaatgagtggatttgattctgcatatcaacaagttcatgaaaatcaacaaatattgcatgtgaattcatcaaacagcccgactcttcaacttagtggatttgaatatggtgatgaccacattggaatacaaggcttgctggaagctgtactatctgtaatattttcaccgtagtatgattctttaatcccagcataggttgtggtctggtgtaaggtgtaagagtagtgaacttatcaagtaattagggattttgatatttgtacatggattagatattggaattttctcatcaattaattactttcttttattgactttgatgtgcaggtcgtgaccaacttttagtaattaataatattacaatccatttcattcttaaaaggaaaagtaaacttgtattttttataataaattttaaagacttcttcctcatctgatccaagatgaatagcacacatgcacttgacatattaccatactcgctgagcaaatgtctagtagcttccattttttcaggcttacactagtgccttttcgatattcttagagatgagtccaggaacatccttgaggggatggaaagtgagtccaactgtatggaaggatggtgcaccatctccaaacaatagccttgttggtacatcatgtaaagctaggcatttcgacaccgctggtggtgcaaaagatgagatgggtagtcttggacttgggttgaccccattccttgatcgatcgccttagttgcagcctcttttcccaactttggtgccgatagccatgacagtggcagggccttctgcacgttgtgcctgacggatctcttcaacactgttaattttctgaagcaaagaatgaaagtgaagaagtagcaacgaaagaaaaggctttgatggatgttgcaaagtgggtttggaagggtggatatatatatatatatatatagagagagagagagagacgtagaatgatagaatgatgcataattgaattgaaaagggtaggtacatgcatgcagtgcatgcttccttcctctgatattgcgcttgtggtgtgcacccactgcatgtctaagttcaccgctgacaaccaacccacttgtttcctctttggaattacttttctattgctgttttttaaagagagttttcagaaaaataattattttcaatcacgtgttgttttttttttccctctttagttcattatcttccacaattattttactttgatatatcaagttttaaaaattttattttgttcttttatgtttttgaaatatattgttttgatcattcttttaatttttcatttaaaacgttaatatttcgttaatttttaaatttaaaataatcaaaatgatacatttaaaaaacataaagaatcaaaatgatacattttaattaatggatttcctaactaacctacccaagattatctaaccaaattgagtaatttaatataaaatattatttttaaattttatcaattaacaaatgatcactagtatataattaattagaataggccattaaccaaatctaaccaatttggttatgtagtttgttgtgaggtctaacatgtttttaaataatatattttataaaattaaaaatattattttttatattatcattacattaaatagaataacattattgaaataagtaaataatatatttgaaggaaattaattttaaaatattttagtttttctttaaatttatcttatatttcaatttttctaagcttttttagtttgcggcaatttcagaattcgtaattacaacaatatatttagtaaatattttttaattatttactaaatttattaatgtagaagcgagaaaaaggagtcagtcaataaaaagggcacgtataattgtagattaatttattactgtagattattatactttatcttttgactatgacttagatgttgttatgcttgcaagactttagatatgataggaacgagtacaatgtactagaggtgaacaaggcttagttatgagaattgcatggacccaggatttgttcataacatatcaaggggtgaaggaagagacgtgtttcatctaactgaattcaagacctactacttcttaagtggtggaggctattgttggcatgggatgaaggttgctatatctgttactgaaggtgttgctgcacccactccagcaccttcaccaaaaggtggtgctccagcaagttcaccagaatgtggtgctccagcaccttcaccagaaagttgttgtgcttcagatggcattcaagtcaaccaaatacctttggtgttaatctttgtcttgatgtgggatatctcttctgataacaccagttactagaaatgctaggccatatgtactattgcaccagttgtaattgttgtattgatttgactttgtgtgatggtaagttaaactatggaattcaaggtatcttttaaatttactaataaattgtttggcctagtggtgtggtttagatagtttatatgaagttgcaagttcaaatttcattgtcccgctatcgtacacaaaaataaataaagaatctattcgcacatactactattataatagtaatgccaaacaatattatttgagaaaaagataaaaggaaaaaagggaagagagattgtttatcatgaactaattttaatgttttttttttttcgtttttaacaaatcaacaattttggatcatgtgctattacttaaaacttaccaacaaagcaaattttccattagttttgtgtaaatatatagctactgcaaatgttggatttaaatgaaccctatatagggaagaacaacaggattaataagggacaatattctttggtttcatgcgaggcatttgccaatacaaaatatagagaatccgtatgggcacgaaacaaagtaaaatctaacttgttactacattaaacatgtcctccaaaaccaatagtattagatggcacaaaagacaaaaaaattatcaataagatctctttgtgccgtttgatttgaagctcagtgcaatgaagtgaacttttgcgtgatatgatcaaaaagcacacaaaaaatcaagcataactgttcagcaccaacatcagaataacaaagagaacaaaaacttttttggtgtctgctgtttgtccgtgttcagggtaggggatcagaatttagaaccataatgacttccattagaaagaaaacaacaaacatattacttttatgaccaacattgcctttgaaaaggtatttgcgattaacagtcaagaacagtgaatatcttttacggcttctcgtgttgaatctgttctacagtcaaggttggtaacaaagccacagcctcaccatcaatcacaagaaggtcatcattcttgaaacaccttgtcttaaactttgcactgaatagcattgagaaacattcatttagaaacaaaattactccttgtttaaaaaagaatgcacaataataacagcaggactaaacttacagatatcgatttttattttctctcagattagttgcttgcacttcaccaataatctgatctccaatatagactgggaacttaaaattcaagttttgagatacatacacagctccaggctgcaattattgaaaattgaagtggccagggaagaagaggaatttaagaaagttatcacagaatgagaatatttcaatgaatgacttcatagcattgcctcaattcacatcattaagcactttaaaatcaagtcttttattcaagttgaccaaatccaatgacaagtaccaatttttcaagcagtagaactagaacccgtgttagcatttaaattgaccacttaatagcatgttggtgatttgcattttccaaccacatccaaaaccaaattcacgtcatgtatgccaagttaatgtggaagctaaaaaaatttacttcaaaaggacgcggatcacactgacataacgccaatccagacacacgataagtcctttatccatgtttttattttcatgtctttcagaaatactataaaatttaagctttttacatgtgtctccctttctacttctgattaatcatgacacattttaatctatgcaataagtgaggggtcacttgaccttatttcacactccttatagtggagattacaattccacatcttatccgtcttcattttatgatactctatctcatgtcataattttccattatggtgtctaatactcaagtttacagaaaggatgttcatgggggcaaggggatttggacccggaatcaacttagagttccccaaagctgctgactgtggcagaaatctcacacttacaaaaagcacaaacaaattaacttttacatgtaaaaatgtatgctacagagtacagagtataaaattcagtctagaaaactaataatagaactctactaatttatctgtttattcacattaatttaatattgagatgagaacgttaactatctcattttaggaggcatatcaaaatttaaagagagggtaagtatgaaacttacaaaatgtgatgagatgatatgaggaaagagagaagccacaagcatcccatgtaccagtggaccttcaaatccaacatctttggcagcagcagaatcagtatgcaaaggattagaatcacaactcaccttggagtattggagaacatcttcctcagtataaacccttgcttttctcaagacatccccaggcttaattacattaggagttgcagaagtaaagcaccttaggctcagagaatggactttgtgacaatgtaaatttcttatgagcatttttgcaagggttcaaatcaacaaaacaaggccctgatgtggtcccccactaactgtaaatcaagtaaagtgcaacttaatattcccacaactggtagatgaggtttcttgaggtaactggtggcatggacttaggtcaaacagctggtgggcgtttgagcagcacgggaaacagtgtacattggtcaatggtatgggttcattgctcttggagggatattaacacaagcagaattatagggtgctgttgtcaagggattactggtctcatgcactatgtttgtcaaaatctgataagttttatggagcctagtttttttacggatcagaaagatgcaccacacaggtaaataagaaaaaataacgaattacttttaaatttttacaaaataaattaatttttttttcatttttagaggttgagtatatgtatatccaacttattttatgtcaatgtaactcttcacgtcatcaatttttttcttgcatgatcctgtattcctgcctgtattaaaataatataaaaaatttatatatttattgaaaagtttcaaaagaaatcactattataatgattaaggtgacaattataataaaattttgaaaaattaattgtgtttgttatttttatgataatggttaaaattattatcatttaaataaaaaatagttgtaattttatgtgaaaaaataataattttttaaatattattacttattaaaaattagacatttaaataattataaagaatttttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgttaattaatattttgaaaataacttgttatgtaaaccttaattatgcttttctctgttcatatgtttttgaagatttagactttaaagtgcacctttaaaactatcttttctgggattgagttttctggtgtattgtagtatttggtttcaatcagttgaaaagtatgtctaattttcatgataaatgaagttgtggaaggttcaaattgtaataagagaaccatgatccttgatcttaatttgtttatgtccctattcatctcttaaattatgatctccatcacaaaggatcctacattctattagataaatacttgaatgcataaccactagggtcaatctagtgacagagctttaaggtaatatgcataagatcataagtttgaacctatcattgtaaaaaaaagaagataaatacttatatgtaaacgcccatgccatgattccaccatacagggaaatttttgtcttgtcatactttcttatctgggttgccggtgtctgaatgcttcctttttttgatattggcctgttaaattctaaccttttttttttgtatttaagcaatcttattcttttgttcagttagatcatttaattgacaatatgttgtgtggatgcatccttattgcaggatgcagcttgagggtcggccctgaggcaggatcaacagggcgtctattcagggtctaaaattttttgtctgggtagtttaagtaaaatttatttttttaaaaaataaaatatatgttaggggtttattttatgtgttagagacccattttttctatctcttagttttaatattatttgtatttcaaaaaatttgtgtgtcagggtccatttttccatccattagttttaatattatttgaatttcaaaaaatttatgtattaggggcccattttttgtgtgttagagatccatttttttcatcccttagttttaatattaattgtatttcaaaaaatttatgtattaagggctcattttttctatctcttaattttaatattttttgtattttaaaaaatttgtgtgttaggagacatgtttgtgccttctatgtataatgaatttaagaaattagctaaggaagatactgcggctaattataattatggtatagagtgccttttcagattttacaagtaccaattccaattctgtcttttctcatttgtttgagaagatagaaccatcatttagatttcatcgtctattttgtcgagtaaagtaataggctaaagtcttctgaattttcatctattgtttctttggagaagctgattaaattgctttatgttctctatttttatttttatttttctttagaagacatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggcagagttttgatggcatccccaattttgatgagaactcttaacaacataacaatgagttgttgtggagtagcggcctactttttgaaagaagattgtttgtttcttctctatatttggttgagttgattatggctcatcaagaggattgctgatagccaagtcttttcaggtttctttgatggatcattctatatggtatataccactgcatcctttctttggtgaatcttgcaaacattgagagacacattttcttttctccaaatgttgtacataagttgatagactagaagttgtgacattacagcataagaaaaagaggttcttgtttttatttttggtgggggttaaaagggggaaaagggttgtacttatatctttgccaaatttgaacaataagagtgagaatcttcttactttgtaacttggcgtgctcatttaatttatatgtaacaattattnnnnnnnnnnnnnnnnnnnnnnnnnnnnnnagttaaaaaaaaaaaaacaaatgctaagaaaaagaagaaatgagacaagagaaaagaaaaaattatttgatgtttcttgataaaaaaaatattagttaatgtttatagcaagtaaaattagtcactgaaatggagatattcatgacagaaccaaaaaattatttaatgttccagtattggaatcgagtttaaaagctgaaaacatagttttggtggttgtcaagcctgtttagcagcattgcagccaatgaaaacatgtcagtgagtttccaaattttataaacggtgagaacaaagatgaataaatgactctaagaaatccatataagcactttccattggagatgctcttattaccctatatcaagtattcttgtttcttaatttattgtgtgctctttttaaaacaaaatcattattttgaaaaataaaaatattattttctaaattctgattgcacaaaatacaagaacatcattgaaatgagaaaatcatatatttaaataacttttttatatatttttaaatttttatatttcagaattttcttaacattttaatttgaggtcaaatttgaattcttaattataacaatatattattagatacattttaagataatttgatgttattgaattctgtttcaataaattattctgtttcaataaattactttttatgttctaaaaatattgatacacaataatataggctattttgagtattttttttcttttgtaattaatacttaagtttctttgatttggtaattatcttataaactactttgctacacaagtttattttagtgacttattttcataaattatttgaagtagtttataaaaaataaattagcttatagtttaatttttctctcttaattttatccttattattttatttgacattcggttttactctttcgttcaatttaaaaaaatcatctttttgttgtttaggaaaaaaatcctattgtctaatttatcatttttactaggcatgacaacgaggatgggttttgcatttcccatccccgccctctactctaaaaccgctctctgatccctattgggattaaaaatatataccccatctcggatggggtcgattttccccgtctcgatccaccctcgctaattaattaaaattaaaaaaattagaaaaataatataacttttgttattgaaaaaatgggccgaaaatgctagttacataacaaaaaaataataataaattcacattcaaaatatgagagtgagatcataattaaaaattacaaaaccaaatcaattagtttaattaaaatcataaaatatagttattgcataaaataaggacatgcatatttaatttctcacaaaatacgatatcatttaaatatatattgtccaaaaattaagtagcacatcatatgattaagtatcacatcctttaaattacataacaaaaaaagaaacaacttaaatataattttttttaatgttatttattacggggtggttcagggcggatatcagttatcccataccccccctttttaattaacagggaaaatccgactccgaccccaaacccggtcgacttgatttttccccatcaaagtcggggagagttcgattcgatccccacggggtcagattccggtgtcatgcctaataccaaatcatgctttttcctctctattttttagtaatatcggtgactttttaatatttcatttatcttttaaataaattctaaaatatattttgtttaaaaattaaaaaatcaatcaaattacttaattaaatcaatctaatttttttggattgataaattttgaaatatctaaaaaatcttattgtattcaatcatttgaaatattttaattgttttaaatctatttttttgtcaactttgagattttcaaataaaaataggtgaatattgacgaatgcagtgcatttatttaaataacagtgtaagggtaggaaggaaatcaactttggtcgactcgattttgaaagatttgtgactaatctgttaattgaaatataagagttaattttagtttaattatattatataaattattttaaaatttagtttaagtcttatacttcttaaaaaattatttaaaatctcactttttagtgataatattaacaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatattagttaaaatttattaaaacctataaaattgaaaaaaagtttttaaatgagaagtaggatcataaaatttgtgacctctaataaattttaactaataataaatattgtgtttaaaataacgttttaaaaatgtattactataatttctcatttatttggataagtaaatttattatgattaataattttgaaatctttgggtaagcaactttgaaagaatttttttttttcaaattttaaagaataatgagtatcacttgggcgccaaattttagcgcgtcatgctttgttaaataagaagccctgtgaacggaaagaaaggcaatttgagtttgaagcttcaaactttgaaagccataaaagaagaaaacaatgtctcagttatataataacgattggaatgatgatgtttatgactacaatctgctttttgattgcgatgatatatggtcgacgctgaactttgctacccagattcctatggcggaggacacccaacaccaccacacaccgctgaacgttgcaaccctagttgcggaggacacccaacaccaccagacaccgctgaacgttgcaaccctagttgcggaggacacccaacaccaccagacattgcccaatcacgtgaaccagattgcgtgggctccggtcgagttgcccagccacccagttgaggcgctggtgcataacggtggtggttccatgatgcagaacgctggttcatcggttcggcgcaagcaagggagaaggaatacatggactgaagaagaacataggtaggtttttaatatattgtatagaaatcaaatgaatggaagtttctcgatttttcctctcatatttgttttttaatggcaggttgtttttacttgggctccaaaaacatgggaagggaaactggatagaaatatcaaggttggttaaaacaagatcccctactcaaattgccagtcatgcccaaaagtatttcattcgccaaaatgcctcacccatgcagaaaaaaagaaaaagcattcatgataaaaacttacattacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatagtattagatggcacaaaagacaaaaaaattatcaataagatctctttgtgccgtttgatttgaagctcagtgcaatgaagtgaacttttgcgtgatatgatcaaaaagcacacaaaaaatcatgcataactgttcagcaccaacatcagaataacaaagagaacaaaaacttttttggtgtctgctgtttgtccgtgttcagggtaggggatcagaatttagaaccataatgacttccattagaaagaaaacaacaaacatattacttttatgaccaacattgcctttgaaaaggtatttacgattaacagacaagaacagtgaatatcttttacggcttctcgtgttgaatctgttctacagtcaaggttggtaacaaagccacagcctcaccatcaatcacaagaaggtcatcattcttgaaacaccttgtcttaaactttgcactgaatagtattgagaaacattcatttagcaacaaaattactccttgtttaaaaaagaatgcacaataataacagcaggactaaacttacagatatcgatttttattttctctcagattagttgcttgcacttcaccaataatctgatctccaatatagactgggaacttaaaattcaagttttgagatacatacacagctccaggctgcaattattgaaaattgaagtggccagggaagaagaggaatttaagaaagttatcacagaatgagaatatttcaatgaatgacttcatagtattgcctcaattcccatcactaagcactttaaaatcaagtcttttattcaagttgaccaaatccaatgacaagtaccaatttttcaagcagtagaactagaacccgtgttagcatttaaattgaccacttaatagcatgttggtgatttgcattttccaaccacatccaaaaccaaattcacgtcaagtatgccaagttaatgtggaagctaaaaaaatttacttcaaaaggacgcggatcacactgacataacgccaatccagacacacgataagtcctttatccatgtttttattttcatgtctttcagaaatactataaaatttaagctttttacatgtgtctccctttctacttctgattaatcatgacacattttaatctatgcaataagtgaggggtcacttgaccttatttcacactccttatagtggagattacaatttcacatcttatccgtcttcattttatgatactctatctcatgtcataattttccattatggtgtctaatactcaagtttacagaaaggatgttcatgggggcaaggggatttggacccggaatcaacttagagttccccaaagctgctgactgtggcagaaatctcacacttacaaaaagcacaaacaaattaacttttacatgtaaaaatgtatgctacagagtacagagtatacaattcagtctagaaaactaataatagaactctactaatttatctgtttattcacattaatttaatattgagatgagaacgttaactatctcattttaggaggcatatcaaaatttaaagagagggtaagtatgaaacttacaaaatgtgatgagatgatatgaggaaagagagaagccacaagcatcccatgtaccagtggaccttcaaatccaacatctttggcagcagcagaatcagtatgcaaaggattagaatcacaactcaccttggagtattggagaacatcttcctcagtataaacccttgcttttctcaagacatccccaggcttaattacattaggagttgcagaagtaaagcaccttaggctcagagaatggactttgtgacaatgtaaatttcttatgagcatttttgcaagggttcaaatcaacaaaacaaggccctgatgtggtcccccactaactgtaaatcaagtaaagtgcaacttaatattcccacaactggtagatgaggtttcttgaggtaactggtggcatggacttaggtcaaacagctggtgggcgtttgagcagcacgggaaacagtgtacattggtcaatggtatgggttcattgctcttggagggatattaacacaagcagaattatagggtgctgttgtcaagggattattggtctcatgcactacgtttgtcaaaaactgataagttttatggagcctagtttttttacggatcaggattcaacgaaacggaaagatgcaccacacaggtaaataagaaaaaataaggaattacttttaaatttttacaaaataaataaattttttttaatttttttttcatttttagaggttgagtatatgtatatccaacttattttatgtcaatgtaactcttcacgtcatcaatttttttcttgcatgatcctgtattcctgtatcaatggttgtcaataaataactaatttacttgcatgatcctgtattcctgtctgtattaaaataatataaaaaatttataatcactattataatgattaaggtgacaattataataaaattttgaaaaattaattgtgtttgttatttttatgataatggttaaaattattatcatttaaataaagaatagttctaattttatgtgaaaaaataataattttttaaatattattacttattaaaaattagacatttatataattacaaagaatttttttaactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataacttgctatgtaaatcttaattatgcttttctctgttcatatgtttttgaagatttagactttaaagtgcacctttaaaactatcttttctgggattgatttttctggtgtattgtagtatttagtttcaacatcagttgaaaagtatgtctaattttcatgattaatgaagctgtggaaggttcaaattgtaataagagaaccatgatccttgatcttaatttgtttatgtccctattcatctcctaaattgtgatctccatcacaaaagatcctacattctattagataaatacttgaatgcataaccactagggtcaatctagtgacagagatttaaggtaatatgcataagatcataagtttgaacatatcattgtaaaaaaaaaaaaagataaatacttatatgtaaacgcccatgccatgattccaccatacagggaaatttttgtcttgtcatactttcttatctgggttgcctgtgtctgaatgcttccttttttgtgatattgggctcttaaattctaacctttttttttgtatttaagcaatcttattcttttgttcagttagatcatttaattgacaatatgttgtgtggatgcatccttattgcaggatgcagcttgagggtcggcctggggcagggtcaacatggcgtctattcagggtctaaaattttttgtctggctactttaagtaaaaaaaaaaattttaaaaataaaatatatgttaggggtttattttatgtgttagaggcccattttttctatctcttagttttaatattatttgtatttcaaaaaatttgtgtgtcaggggtccattttttcattccttagttttaatattatttgtatttcaaaaaatttatgtattaggggtccattttttgtgtgttagaggtccatttttccatcccttagttttaatattaattgtatttcaaaaaaattgtgtattaagggctcattttttccatctcttaattttaatattatttgtatttcaaaaaatttgtgtgttaggagacatgtttgtgccttctatgtataatgaatttaagaaattagctaaggaagatgctgcggctaattataattatggtatagagtgccttttcagattttacaggtaccaattccaattctgtcttttctcatttgtttgagaagatagaaccatcatttagatttcatcttctggtctattttgtcgagtaaagtaataggctaaagtcttctgaattttcatctattgtttctttggagaagctgattaaattgctttatgttctctatttttatttttatttttctttagaagacatccaagcatagttcttctaatttttgaatgatttcttgctcagttatggattggagaaggaatttagagatgatttatacgatgattttggacaactcactatggatttctaccataagggcaatctgtatggcctggaaaaatattggtaaaaaaccaaattctcttgcttcttatattctgctgcatattttctgttttgtagtttcattccttttcccaatttcatgtgagatttgttatagtgaaaaaagtaaacatattggttggttagtgtataacctaagttgtattctagattaaaaagattgttcactggtctatgaaatctaattatacagcaccttagttatatttgattatttcctgtttgtctgacttgtttgtgtcacaaaatctttataacatagtttctgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataataataataataataataataataaataaataaataaataaataaataaaagtatctagtacaccaaaaaaaagtatccaaatttattcacatacaattttaaaaacataaatacaaaaaaataaagtattgaatattgcaaaaaaggaaccataatttattgacaaaaaaaattaataaataatatgttgatcggataaaaaaaatgtaatatattgagagattaaatctttataaaatatatcatgattaaaattacgggaaagataagcataatcaaataaataaaacataaatctaacattaagaaaaaattgaaaaggaagatctacaaaaattgggttcctctgcaaaatatataaaggtgtggtatagatacctcgtcaaagtgcaatacttggttcccaagaaataagacagcgtctatagcaattttaaattgatcacaaaagttttcataaagatggagtggtgcgatcattgttgcaggttttgtcaaacaagagtggaaaacatcatcgatgaatcttcaggcaaatattgcaggtgaagtatatatattactagtgttgttcctatttcctttcctcttaaggtttttggggaaaactattattatattttcacgccattaatgatttttaatgtcttgtattttgcagctcttgcaccatgtgtgggaagattttattagacttgggtagtaatcctagaagaataaagaaaaggagatagagcaatgtaaaaattgtgaaaaaagaacgtgtaagtactcttagtcttggttcttttttttttttgttaattaatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattattggactgaaatggagcattttgtttattcttgatggtagatttgtggaacagtatgagcagttctaaatgttaacactactcacctatgcttagctaatccaaaatagatcatcatattggaaatatgttagtttctatgtcaaatgctagcatactattttattaatattgcatttctatatttttgggtgaatggaggttgccatattctaaggcaaggcactgtctccctcatatctgttggatatagagaaatgtagttttcttctgttgttttggcactcctcttcaccatattatcactctctagaacttttgttcttacatatttatatttatatttatggcattggtagggcatttcgtcattaccgcaaggtctgtggccagaaagaaccgttgaatcaacaccctgaactggacaggttgctttgagaagagtatcctagattggaggatttccgtgccaaagaaaagagtatggtaaaagaggatgtcaattaagttgagtgatatgtccaaatggtaaatacatatggcagagttttgatggcatccccaattttgatgagaactcttaacaacataacaatgagttgttgtggagtagcggcctactttttgaaagaagattgtttgtttcttctctatatttggttgagttgattatggctcatcaagaggattgctgatagccaagtcttttcaggtttctttgatggatcattctatatggtatataccactgcatcctttctttggtgaatcttgcaaacattgagagacacattttcttttctccaaatgttgtacataagttgatagactagaagttgtgacattacagcataagaaaaagaggttcttgtttttatttttggtgggggttaaaagggggaaaagggttgtacttatatctttgccaaatttgaacaataagagtgagaatcttcttactttgtaacttggcgtgctcatttaatttatatgtaacaattattttcttaccaaattgttattggtatggtttataaagcaaaatgtttttggtacaactaaaatgggactagttgtctcctttaattttgggagagtatttttggaatgattgtctgtgaaaaagataaaagtcaaggtaaaacaattatatgcggtgtaagatgaaatgaatttaaattatttgatgtttcttcatcatcatcaacatcacatttaacctaagttaattagaatcggtggtagatgaactcaatattagatatgaaaaagttaaaaaaaatgctaagaaaaagaagaaatgagacaagagaaaagaaaaaattatttgatgtttcttgataaaaaaaaatattagttaatgtttatagcaagtaaaattagtcactgaaatggagatattcatgacagaaccaaaaaattatttaatgttcaagtaatggaatcgagtttaaaagctgaaaacatagttttggtggttgtcaagcctgtttagcatcatcgcagccaatgaaaacatgtcagtcagtttccaaattttatgaacggtaagaacaaagatgaataaatgactctaaaaaacccatataagcactttccattggaaatgctcttattaccctatatcaagtattattgtttcttaatttattgagtgctctttttaaaacaaaatcattattttgaaaaataaaaatattattttctaaattatgattgcacaaaatacaagaacatcattgaaatgagaaaatcatatatttaaataacttttttatatatttttaaatttttatatttcagaattttcttaacattttaatttgaggtcaaatttgaattcttaattataacaatatattattagatacattttaagataatttgatgttattgaattctgtttcaataatttactttttatgttctaaaaatattgatacacaataatataggctattttgagtatttttttttcttttgtaattaatacttaagtttctttgatttggtaattatcttataaactactttgctatacaagtttattttagtgacttattttcataaattatttgaagtagtttataaaagataaattagcttatattttaattttaatttctctcttaattttatccttattattttatttgacattcggttttactctttcattcaatttaaaaaatcatctttttgttgtttagaaaaaaaaatcctattatctaatttatcatttttactaggcatgataacgaggacggattttgcattccccatccccgccctctactctaaaaccgctctccgattcctattgggattaaaaatatataccccatcccggatggggtcgattttccccgtctcgatccaccctcgctaattaattaaaattaaaaaaattagaaaaataatataacttttgttattgaaaaaatgggcctaaaatgctagtttcataacaaaaaaataataataaattcacattcaaaatatgagaatgagatcataattaaaaattacaaaaccaaatcaattaatttaattaaaatcataaaatatagttattgcataaaataaggacatgcatatttaatttttcacaaaatacgatatcatttaaatatatattgtccaaaaattaagtaacacatcatatgattaagtatcacatccttcaaattacataataaaataagaaacaacttaaatataatttttttaatgttatttattacggggcgggttcaggacgtatatcagttatcccataccaccctgttttaattaacaaggaaaatccgaccctgaccccgaacctgatcgacttgatttttcccgtcaaagtcggggagagttcgatccgatccccatgtggtcggattccgctgtcatgcctaataccaaatcatgtttttccctctctattttttagtaatattggtgactttttaatatttcatttatcttttaaataaattctaaaatatattttgtttaaaaattaaaaaaatcaatcaaattacttaattaaatcaatctaatttttttggattgataaattttgaaatatctcaaaaatcttattgtattcaatcatttgaaatattttaattggtttaaatctattttttttgtcaactttgagattttcaaataaaaataggtgaatattgaataatgcagtgcatttatttaaataacagtgtaagggtaggaaggaaatcaactttggtcgactcgattttgaaagatttgtgactaatctgttaattgaaatataagagttaattttagtttaattatattatataaattattttaaaatttagtttaagtcttatacttcttaaaaaattatttaaaatctcactttttagtgataatattaacaaataatgtaacgacctaaatatttacttatttttatctttccttaagggtaatctataagaaacgtataatagtaaaatttttaaaacgtaaaatttgcaaaagatttgttactcatatacatagctaatgtctctgatacaaaagtttatataatacaagtacactacttttctcaaaaatccagcgtaattcataacttcttttatatatatcttcactactccaaggcctcatggaacctgttcatcattgccatctaaaaaaaaaacatgaaacaaatagggtgagaaataaatttctcagtaggcaaagctaaatcccgatcctattattaggttagtaaaatcattcaaataatcaaacacatccacaagtaatatgcaactatatgaatgcatgagatgaactatcccagggcaaatggcctccacatatcgtactgtatgtggccacactgagtgtggacgctgctatagtcttacgcaaacatgcatgaattttgccatatatccttgcacctgggtactacatatcgtactgtatgtagtatcagattctgtttccccaaagcctcgtactggacttggaacatgaaaacatgaatccacctatcttaatcacatcaacatatcaacatccataaagatcaaattcataagcaaaatatatatcatatcattatttatatcataagtatggttacgccaccatatcttatccattaagcttatgagtatggttacaccaccataccttaatcaagtaagattattaccaacttatgcataaccagagaataacctgaataaccttaatctacagaaaaattatgttagtaatctaactaataatcctcaatataaataatatctaatttctttaaacttttgcaagcaaagattcgcacttagtatacatattaattaatcctcaaaatcaaataattaatcctcaaaatcaaatcatcaaatatttaaaccattcaactccacaccattcatcttctacttcaaaatttaaatcaaaaacatatccataaaatatacacagaccgtccaaagtatcattaaaattacctcaaaagatcatcaaatggacttccttacttcactaatattgatgggtataaatcatagcctatattataacttaaatcaacatattctcatcaaagagtaacctttaaacattacgaaattcaagcctaaatatcaaccataaatcagcctactaaaacatgtaaattaacctaaaccattgattaactagagatttaaacttcacctacctcaagtgagtttgattcttgaaattgaatggataaatgtctcccttccttccttccttccttgggagaatcctctatgagatgaagccttgatatccttttgctaagcttgtcaaaagttcttcctaaggttgctaggtttctcacgaaatttcttcaaggtgatgggtttgtttttcttacttgattcaagctttaaaagagaaagatggaatgaaatgaagatggtttagggagagagtggtcacgtgaatgagctaggagggatggcttggaatggtttgcacttaggtctcccttccccctttatatagtgttgaagaaatgattacttagagaaaaatctaataagtcatcattattcctttacaagtgtccctacacttgttataatcttaaggcttcttcctttcttccttccaagtgtcctaccacttggcatgatcttagagcttcttctcctttacttccaagtgtccaaaatcatgaagtttctccatttctcttgcattttcgtgaagtagcttgttcttgagtctatcccaaacctgttttagtaaaattctaattctggtctcattaaccgttggatcttcttgaaattttaaaggtacattactatcttacatatgtaacttttgaccgttgggatttttgaaataatgtttacaactgtccacgtgcaagacggaagagtgtagagaaatcttggcttgatttttgtattaccttgcatccatgccatacaagtgtcttgccacttgttttcatcctatggcttatcttccaagtggctgaattcaagaagcttcttcctcattctccatgcttctccacttgaatgacaagctcaaagggaaagaatacaaatttttcttcctttcatgctacatgtggtcatttttgatgatgaataaaaatctagtttcaatatggtattttcttaaaaagaaattcaagttattttgaattcttttgtctaaagaaaatgttgaatattagaattctagatgttcctaagaatttatcccaatgatagtttaaattaatcccaagcattcttatacagggcaatacataaacctttcatttttcactacatctttatcttatttttgattggtctatacttcttctgaccatcaaaattaataaaccattttattaaataggtatattcatcctataattaagagaaaattctatagattttatgtatcatttttccatatttttctgatgcttgagttttcttgaatacaacctcaaagttgtcatcttccaaaatttgtagaaattttattctagagttttgtgtcacaaaatatgttaatacttagtcagctaagtgtattttataatttcatcaagtttctacaaaatttctaaagttatttgagcatttttggcataggggcattttggtaattatgccattcaacctaggggtattttggttattttcaaaaatttgcaaggacatttttgtaattttcatcctaagggtattctagtaatttctacttcatggaaagagtgatttagtcatttttcttcaaatatacttgtatccaaacattatcacatttccacaagtgcttaataaaattttgaggatgttacaaataaaattatgaaattacttataaataagttaattaatataattatgtaaatttaaactttaataaattaataaacatatgatttgaaaagatgatgataaaatttatataataatatattatgtatattatttagagaaatgttaataatatattccctaacatactatttataacaaatatgtaatattagttaaaatttattaaaaactataaaattgagaaaaagtttttaaataagaagtaggatcattaaaatttgtgatttctaataaattttaactaataataaatattgaatttaatattactttttaaaaatgtattactataatttctcatttatttggataagtaaatttattatgattaacaattttgaaatctttggataagcaactttgaaagaaaaaaaaataaatttcaaattttaaagaataatgagtgtcacttgggcgccaaattttagcgcgtcatgctttgttaaataagaagccctgtcaacggaaagaaagcaatttttgaagcttcaaactttgaaagccataaaagaagaaaacaatgtctgagttatataataacgattggaatgatgatgtttatgactacaatctgctttttgattgcgatgatatatggtcgacgctgaactttgctacccagattcctatggcggaggacacccaacaccaccacacaccgctgaacgttgcaaccctagttgcggaggacacccaacaccaccagacaccgctgaacgttgctacccaggttgcggaggacacccaacaccaccgcacaccactgaacgttgctaccctggttgcggaggacacccaacaccaccagacaccgctgaacgttgcaaccctagttgcggaggacacccaacaccaccagacaccgctgaacgttgcaaccctagttgcggaggacacccaacaccaccagacattacccaatcacgtgaaccagattgcgtgggctccggtcgagttgcccagccacccagttgaggcgctggtgcataacggtggtggttccatgatgcagaacgctggttcaccggttcggcgcaagcaagggagaaggaatacatggactgaagaagaacataggtatgtttttaatatattgtatagaaatcaaatgaatggaagtttctcgatttttcctctcatatttggtttttaatggcaggttgtttttacttgggctccaaaaacatgggaagggaaactggatagaaatatcaaggttggttaaaacaagatcccctactcaaattgccagtcatgcccaaaagtatttcattcgccaaaatgcctcacccatgcagaaaaaaagaaaaagcattcatgataaaaacttacattacacaaatggagttcctcacatcattgatccacaaaattcaattcctcttactggaattcaacaagttcacgaaatgcaacaaaaaaaacaaaagttgccgctgaatccaccaaatagcgtgactcatcaaatgagtggatttgattctgcatatcaacaagttcatgaaaatcaacaaatattgcatgtgaattcatcaaacagcccgactcttcaacttagtggatttgaatatggtgatgaccacattggaatacaaggcttgctggaagctgtactatctgtaatattttcaccgtagtatgattctttaatcccagcatacgttgtggtctggtgtaaggtgtaagagtagtgaacttatcaagtaattagggattttgatatttgtacatggattagatattggaattttctcatcaattactttcttttattgactttgatgtgcaggtcgtgaccaacttttagtaataatattacaatccatttcattcttaaaaggaaaagtaaacttgtattttttataataaattttaaagacttattcctcatctgatccaagatgaatagcacacatgcacttgacatattaccatactcgcggagcaaatgtctagtagcttccattttttcaggcttacactagtgccttttcgatattcttagagatgagtccaggaacatccttgaggggatggaatgtgagtccaacttggcgaaggtgaccatcaatagccccttcactgtatggaaggatggtgcaccatctccaaacaataaacccttgcttttctcaagacatccccaggcttaattacattaggagttgcagatgaagtaaagcaccttaggctcagagaatggactttgtgacaatgtaaatttcttatgagcatttttgcaagggttcaaatcaacaaaacaaggccctgatgtggtcccccactaactgtaaatcaagtaaagtgcaacttaatattcccacaactggtagatgaggtttcttgagttaactggtggcatggacttaggtcaaacagctggtgggcgtttgagcagcacgggaaacagtgtacattggtcaatggtatgggttcattgctcttggagggatattaacacaagcagaattatagggtgctgttgtcaagggattactggtctcatgcactatgtttgtcaaaatctgataagttttatggagcctagtttttttacggatcagaaagatgcaccacacaggtaaataagaaaaaataaggaattacttttaaatttttacaaaataaattaattttttttgtcatttttagaggttgagtatatgtatatccaacttattttaatttatgtcaatgtaactcttcacgtcatcaatttttttcttgcatgatcctgtattcctgtatcaatggttgtcaataaataactaatttacttgcatgatcctgtattcctgactgtattaaaataatataaaaaatttatacatttattaaaaagtttcaaaagaaatcactattataatgattaaggtgacaattataataaaattttgaaaaattgattatgtttgttatttttatgataatggttaaaattattatcatttaaataaaaaatagttttaattttatgtgaaaaaataataattttttaaatattattacttattaaaaattagacatttaaataattataaagaatttttttaactcttttaataagtttttgaatcgtctctggtcatcatgtgatatataaagtaatatttagaacttaacatacttggcaattaatagtacgagttttcctatccaaacaaatttaactatattgaaaaaattgaatcaaaaaattaaattattataaaaatatataaaaaaaatggaagggtgaaatattattaacaaaatacgttaacaaagaattagatttttttaattatttatgcatatcattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatgtaatcttaaataataataataataataataataataataataaataaataaataaaagtatccagcacacaaaaaaaaagtatccaaatttattcacatacaattttaaaaacataaatacaaaaaaataaagtattgaatattgcaaaaaaggaaccataaattattgacaaaaaaaaattaatagataatatgttgagcggataaaaaaaatgtaatatattgagagattaaatctttataaaatatatcatgattaaaattacgggaaagataagcataatcaaataaataaaacataaatctaacattaagaaaaaattgaaaaggatgatctacaaaaattgggttcctctgcaaaatatataacagtgtggtatagatacctcgtcaaagtgcaatacttggttcccaagaaataagacagtgtctatagcaattttaaattgatcacaaaagttttcataaagatggagtggtgcgatcattgttgcaggttttgtcaaacaagagtggaaaacatcatcgatgaatcttcaggcaaatattgcaggtgaagtatatatattactagtgttgttcctattttctttcctcttaaggtttttgggggaaactattattatattttcacgccattaatgatttttaatgtcttgtattttgcagctcttgcaccatgtgtgggaagattttattagacttgggtagtaatcctagaagaataaagaaaaggagaaagagcaatgtaaaaattgtgaaaaaagaacgtgtaagtactcttagtcttggttctttttttttttgttaattaatattttgaaaataacttgctatgtaaatcttaattatgcttttctctgttcatatgtttttgaagatttagactttaaagtgcacctttaaaactatcttttctgggattgatttttctggtgtattgtagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggttacaatgatataattaaaagtcaaaacagaaaataaaaaacaggaaatgaaaatagaaaaggttggtaaaatttgacactttggttggtaaaatttgtaagaagaaaggtttaaacaatttatgtatacgaaacttgaaagagagatcaaatttgcttgatttaaaaaaaattagagatataattaactcaaaaaaaaacctagaagatgaaaataacttacatttcaaattaaagaaataaaaagttaatgtaaaatgacatttttaataaataatttatgaagagattacgtcttaataataataaaaaaaaaacatatgcaatgatatatattttataaaggtgtagtgtatatgcttaatcaaagctatttactggcttcccaaggattcaggacactctgttttgcttatttatgtgactttgaaactgaacgcaattgttaccattgaaatggagatggagtggtgtagtcattgttgcaggctttgccccaccagattggaaaccatctatggtgacatttccgtcaactcttgcaggttaacaactattactactattctcttttcttctctatttttatgctacaaatataaacaatccaatttggcttgtcataaacaatcgaaatatttaaaatcacatttggaacgtgaaaaatcatatcagaattgtagaacccgaagagtctgcgtgtaagatctcgctgcttttggggaaacagtctattttgtatgagaatctatgttcaattctgattgtgtaaattttcttaggtcaataacagttacgttctgccagcggaattagtctataatttagtgaattgagagacatttgtggtcactaaccaggaaaaagaaaaagaatggtaaagaaccaaatatgttagtataagactaatgtaaacaatcgaaattggcttgttaaaatattaaaaaaaaaaaaagttgagataatgggggaaaataatggggattctttgttagtaaaattgtggactttcatgccattgattgatcccagtgatattcaaatttcaatgtgttttgtttacagcgtctgcgctctatgtggaaaggttctgttagacttgaatgcatcgctccacgtaatgttttcaaataagaaaataaataaaagttctagaagaaagaagagagggagaaatatcaagaatgatgtacaagctcagcaagaagaaagtgtaagtactttgatttgtcctcaattttgttcccttttttttgtctgtggaattttgcacgtatagcagctgaattggtcataagttgctatgtaaattctgcatttgttctgtatttagtctctaatgttttgtgacttttagagtgcattgttgaactgtcttttctctgagtttttttctttaatgtcgctgcttctgtttgggcactgctcagaggaatcttatgattttgaatctagattcaaatatggtattatttgattacaatcagctaaagtgtctaatgttcatgatgaggaaaacggtgaaaaatttaaggtcggaattgcaataagagaaccatgatatcacattcattaaaaattaagatcaattgaagccttgatctttgtttatgttggttgcatagacagactccatcatctatgtctcaaatgaaatgaaaataaaacataatgaacgtagttcaattgacaacacacactgagaagtaaaaagcatgagttagattctcgcatgatacactcttgaagagaagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatccaattaatttattttctcaacactatatggaaaaccaaaaaaaaatcttcatacattttaaatcattcaaaattactttgtaatacaacaattatttgatctattttttgctaatcatgttattggtataaagttgttcctcgctgaaagtcataacaaatctccgtcaagaaacatgaacacatagaaggtgagtatttattttctaacatgatttatttgatatccaatggtcaacaaaattcaaacattagatcacttgattaaataacacaagtcgctaccacttgtgttaatcattatttgttaattttaaatgattctttaagaagtaatcaattttaagtgattttttaagaaattttataaattcattatcaataatcttatcaatttttttttaatgaataatatgtttttttttctccacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctacaaaccatgtttatctcttattttattatgatgcctaagtacatagtacatacataactggtgtcaaattctatttatgaacctatttatttatcatgtctaagtacatgcattattggtgtttataaaaatgttttttagtttaaatttaattatcatgtcaaagtacatgcataattggtgttttaattattttgtattttgattacaagtatctttaataatagataattctatctgagttggatatgagtattataagtgataaaatctatcttttaaatatttaatataatgacatgattaaaactcaaacacaattataaattgaaatattctcacacactaattgaagtatgtgtttgatagtggattagtgggtgttatagttatttaaaatgtgaattcaagtatttattgagtgtttgtgtggttcccgaaaaaggacaaaaaaaggtttgaaaagtagtgaatgaaaacaaagaaaaacagcaaataacgacggtgttgggtctggtaacagcgtagcagcctcagcaatttttggctggcaaacacacgcatgccaccacacgtgcacacacacccctatcatattattcattcacatcccctttttcttccttcttccctttcactctctccctcccacaatggacctccatcgccggccgccggccgccgctgacgacggagcaatccgccaccaccccaagaagaggagtgacacttcctctcccaaggcctccgacgccctccctctccctctgtacctcaccaacgcgatcttcttcacgctgttcttctccgttgcgtacttcctcctccaccgctggcgcgacaagatccgcagccacacccctctccacgtcgtcactctctccgagatcgccgccattttctccctcatcgcctccttcatctacctcctcggcttcttcggcatcgacttcgtccagtccttcatctcacgcgcctccaacgacgcctgggacctcgacgacgccgttacagattctccctctccctcgcccgcaattaccaaattgccctcacgggatgcctcaattatattatcctccgaggatgacgaggagattgtaaactccgtcgtggagggcgtcacgccctcctacgcgctcgagtcccgcctcggcgactgtcgccgcgccgcggcgattcgacgcgcggcgctgcagcgcctgacggggcagtcgcttgagggcctgccgctggaggggttcgactacgactccattttagggcagtgctgcgaaatgccggtagggtatgtgcagattccggtaggggtggcggggccgttgttgttggatggattcgaatacactgtgccgatggccaccacggaagggtgccttgtggcgagtaccaacagagggtgcaaggccatctatgcttctggtggggccagcagtgtggttttgagggattgcatgtcgagggcacctgttgttagattctccactgccaagagagctgcacagttgaagtttttcttggaggatcctctcaattttgataccttgtcacttgttttcaacaggtttgcttttccaaactcttttgtgtctcaaaaatcaattctaactcacaaaatcatgctgataccatgaagaatggaaggaactatttgttgctttaccttcaccatgaatgttttgttttatattttttttatttctcgacatgaagctataatccaaacacactattaatcattcaggagtcagtatcatgttcattaaaatcatgtttgaattcttgttatattagataaaatcatgttgtagtaccggctaactttattttttttaggtaaaatcatgtttttggttgcatgttgaagaattgattgattttgggtccaaactcaattttgagttgaagcggttttataatggattttactactaatttggttttaatataaaaacaatcaaacattaatcacttcactttaaaattaatttttgaccgaaattaattttgcaaaactaattttcttttttcttaattagcttcattcaaacatggactaagttaattttctgcagtttagggattaacattattttttttttaaatgttaggggagaatcaaaggtatggttttcctttaaaattttgatttgtttgttataattgtgaagaggatgagtgaaggaaatatggtgtatagaggactggaatttggatgttgtttatgggagattatttctttatttatttatttatgcgctgagttttgttgcttggtttaatggtgtttcaggtcgagtagatttgccaggcttcaaggtattcagtgtgctatggctggaaagaatgcttttttgagattcacttgtagcacgggtgatgccatggggatgaacatggtttccaaaggggtgcaaaacgttcttgattttcttcagaatgatttccccgacatggatgttattggcatttctggtaatttctttccctttcccattttgatggatgagatttactagatctttctttctttcctttttaaatttattaggactggatctttcttctgttaacctgaatgatgtcaccattcaccaatgccgtttactttgttatatgctactaatactattagacatcggctctttgtctcctttcattgacgtaattgtttctttcatgaaagtggtccaatcatattatcttaattctttccgtattgtttttgatgttttaacctttttttttatcaatgttgtattgtactagtgtaagctttccgtatcatattgacgtgttagcctatttttatttttattattatctgatttgaacaacttgtgtcatttaatgctgttattgtagaagttcgttatacatgtggtattatcaagttgaattattttcggagattgatttgtttgcttaattatgatctatgaagtatgaactatgaacatgatgcaaaaaattttgactatgccaaactcttgcattcatcaccaatttattttaacttgcttgcatctcttatctcttgaatgcgttggtttatttgatatgatgcctataatcaagacatgctgaaattgttttaatgggaatattaggctgaaattgttttaatgggaatattagactgaaaatgtgatggttatgtactgacttgatccttaggaaattattgttcggacaagaaacctgctgcagtaaattggatcgagggacgtgggaaatcagttgtttgtgaagcaattatcaaagaagaagtggtgcagaaggtattgaagaccaacgtgtctgccctggtagagcttaacatgctcaaaaaccttgctggttctgctgtcgccggtgctcttggtggatttaatgcccatgctagtaacattgtttctgccatctttatagccactggccaagatccagctcaaaatgttgagagttcccattgcataaccatgatggaagccgtcaatgacgggagggaccttcacatctcagtgaccatgccttccattgaggtgatttgacacaccccatatattttcttagacaatactcttctataaagttggttaattttccaattcaatagccaaggtttatacgattcatttttgtgctcacaggtgggtactgttgggggtgggactcaacttgcatcccaatctgcttgcttgaatttgcttggtgtgaagggtgcaagcaaggagtcaccaggatcaaactcaagactcttggccaccattgttgctggatctgttttagcaggagagctgtctctgatgtctgctattgcagcagggcagctagtgaacagccacatgaaatacaacagatcaagcaaagatgtaaccaaaatatcatcatcttgaggtcaaggacgtggttgcagttattaattgtggactctagaataaaaaaaatgagagtaagcggaatttgggaaggaaaatggagaatcattagattagattgttggcatccacgtttggctctgcaatgctgtctatttagatcttctattattttgagagaggaaagtagagttatactctacatgttccctgtccccttctggatccttccttctttcctgtatacttttcattgcttgttctgccgagccattgagtgggtgttaacactcttttttctcctcaaccaagacatttgacgtgttatattctgattcgtttcccctatataatatgcttatcatatctatcattgtagccgaatgggttgatgaatgttctcttcttgtccgatagtccccgtcaattaaacttgaccttatctttttcatgatttactaactcttgtcctatatatatgattttctttcaatcactttataataattaaaagaatgtagctaatttaattagtagtagtactaaacttgtcaacgatttttctttcagtattgtctctaaaattattgagatccctttgttttaagtctttatctaactaatgaatgtatttctgtttaagggtaattttgcaagaatgttaattaacgcaatagataaattggggaaggtcttataaaaaggatttagataattttacaagagatttttgcaaaaagcactcgaggtagtatttagtttatttgcaccatagagaccagagatttttgccattttcattttctgttcaaactaagatatatgtttagcattggtgttttgaggcatttcattggcaaaatgcttctttggtattcaagcataaggatcatcactcaatcatttgatattcgcttatctatgttataggatgaacttctaaattgatattttaaaatagttagtagataattatgttttttttgtcatgctattcggttcctaactgtatatatgaaaaagagttttgttccaagtgtagaatttacttcaatgatttttacacttcaaatgattgtatatgttttcaattcatgtaaataggatactgtttacttttagtcacttgaaattaaattaacttgttttgatctatcgtttataaaagatgctacagtaatctttattttcataaattaattaacttattttgatctatcgtttataaaaaaaatgctatagtaatctttattttcataaattaaggagaaaaaataacatgacgataaaattgacttcacgcgacactaacatattagattgactcattgcttcaagtccaatatgttaagtattgttaaactataaagttaacctcataaacatggtgatggaagaaacgggacctggcagagtgctcccccttggggggccatcccctcaatgggagaattttcttcccattttagatggattcctccatagtgagactgtttttttcttcttcttccaccttcccttttctacctcacaaccacaaccttacttctttttaccattgccttcacccactttccttcctccatttttagctaccatcttcatccctttttctatttttttttataccggataaagtacccgactaagctgagggaacacctggcccatccaaatcgaacacatcccttggctatgtgtatttatatatgtcgaacagtacgtctcgaccttcaacatgtgcaagcaatgagtaccactcgactgtgattatcacccctaaacccatttaagggtgatcacttaattgaaagtgtctaagcatgatcagaaggaatattacttaattgataatcatgatgtgacaaacacacagatctcagacccaacaagattaatataaaaaggcgtgaacccctcaggtaaaaggactgattcattctcacctactcactacatatccttaatagctctgaatcaaaccttcacttgagcgtcaaagtgttttttgcatgtactctttcttttgttttccagacacgtaagcacttgagacacttcggtaggaaaaaccaaacagacaacccttcaacataatagaagaccgttcgataaaaagatagatatatgatgcatttgtgacattgaacattttttttttgtgatttttcctatgcctctctcttctttgtgagtctttttttgccattgaagccaaatcaccaaaggtttttactacttaggcaacactaccttagttagctttgttgcttttctacgaggtccttacataacattgttctacttagatttgctgtgtgttgctttagttcattactggttgacaagtggcaatctggaagggactacaaagaaaaatatgtagaaatgtctaagactctagcaatgtttttatatgtgtagctaatggccgagcgtgcgtgcctgttttattgttgtttatttattgtgcattgttgtaacacaatgctcctttcacagtatcttgagtttgtaggtgtcttttgacattttcaattaatgataactgaacagaaaaaatatattatttgtgtgaagtatttctattaatttttctatttacaaggcattttttcttataatttgtgtcatgtcagacatataaaagagggaaatattttattgaaatatgtaaaatgttttcctacagtttttaaatgcgtttttatatgatttccaataaaaactttcattttttaatttctttaactagtgtcctaaaggtaagaacattcgacagcaagacacattaattaatactatctagtattttttaaattattatattaactaattttgaatgttaaaattctttattgagtttgtgtataaattatttatcctatgtttgaaaaatggttgtaagagatgttatgttttaagtgatgggtatgtaactaagtggaatacttaaaaggaagttttgttgtttagagtaattttatcggactcttgtttccggtaaagaatacatgtcatatatatatatatatataactattgtccagtctctatacatacgttgagttttaaagatgatgaagagacttgctttgaacgtatttcagtcctttgcaaatgggcccaaatatatcattattttttttttttatcacaacacaatattactcttttaattaaacatattatcagagataataaacttttttatataattattaagaaaaatcaacaaacttaaactaattgtatataacaatttctgattaaatagcaatgtatatctttacacgatttagcacgtaaaaatcctttatacaccaaatggtcatggttgtaatatttttggtgggatagagaatgggctgaaggcccaaatgtagataaaaattaaatatcggttcgaaatagagaccagctctaaagaaatctcacgttcactgcgagagcaggagccagaaaactgctgcttctcgaagttcaaaacttaaaccctagttctactctctctctctctctctctctctctctctctctctttcttctgcgtcttcaaccatgtcagcgatgctggtaagttcattctctttctgctctgttacgtgtttccataacctaacctaacctaactcgttgctattggaaatggtgtgggatcaaacagcaacctcagatcattctgctgaaggaaggcacggacacttcgcaagggaagccacagctggtgagcaacatcaatgcctgcaccgccgtcgccgacgtcgtccgcaccaccctcggccctcgcggcatggacaagctcatccacgacgacaagggaaccgtcaccatctccaacgacggcgccaccatcatgaagctcctcgacatcgtccaccctgccgcaaaaatcctcgtcgacatcgccaagtctcaggactccgaggtaactttaacttcccttcgatctcatgcaatgccacttctttcaagatcttttcattttcgcttcattcagattctttaaactttggaattggaattggaattttttgttagtaaatgaactcttgtattgttgtgaatttgaaaaaggttggcgatggaaccaccactgtggtgttgcttgcagctgagtttttaagggaggccaagccattcattgaagatggtgttcactctcaaaacttgatacggagctataggacggcctgctccttggtacagagctatctccaattttatttatttacgccttgtttgaataaacttctatataaccgtttataggagaataagttaacaagctgaaatgaattgagtttctctcttaagttaaaattaacttatgcactttaacttttgcaaaagttctcttatctaacttctccggatgttgatgtgcagaagtttattttagcttatgggagaagttcgattcattttaccttttttattttctcttataagtgcttatggaaaagtttacctaagcagggcctggccttaatttttcttttatttttgtcttaaattactgttgaataatgtaagtggaaggatgttcctgatttgtcacattacttttgtcttgttttatcattggtgcaggctattgagaagattaaagatttagctgttagcatagaggggaaaagtctggaagaaaagaaaagcttgcttgcaaagtgtgcttctaccactctttcttcgaagcttataggtggagagaaagaattctttgcacccatggttgtggatgctgtaatttcaattgaaaatgaagacaggttgaacatgattggaataaagaaggtacatgtgttggttcttttgcaatcttgtatttgtgtgctgcattctctcttttacattggtgattgtttgattgtcctccacattaacaatagtgctcattaaatattttcttcataattgtaaaattaagttgatttttttaatagatgaattattaataatacattgtcatgagaaatgggtaatttagttcaataatcactttctctctctctagattttaggatagttattagtttccttaattcttgtgctatatactctaaagtgacaattatttgagaatgagtaaaaagcatcatcatcatcatcatttatatttagtgcctccctccccccaaataaagcctgccgagtttttatagtattgtaattagattttttgggcttccacttcccttcagatatggtaaagtagatgtgttatatttgttttccatgttctataataatgttttttggaattttaaatgtgtgcatttgtatttgattgcccaaatgatgtaatagaaagtacaaacaatcaactaaccaaaatggttacgaatgaagatcaaggagtgttactgtcatgcaggattttgtttttatggttaaatgtttaattacatgttaatcaattttgtgttagtgtttagaatttttttgaaaatcaatcgtggagactcaggttttcttctacaggttcctggtggtaccatgcgggactcatttctagtgaatggtgttgccttcaaaaagacattttcatatgctgggtttgagcaacagcccaagaagtttctcaatccaaaaatactattactaaatgttgagttggagctaaaatctgagaaagaaaatgcagaaataaggtatttttgttttaattttttttttgtttgacgatgctgacctgggatcttagtgaaggattgcataccaaattggaattcattctttttttcttgttctctacaggttatcagatcctgcgcaatatcagtcaatagttgatgcagaatggaatattatttatgacaagttggataaatgtgtcagcagtggtgccaaagttgttctttcacgattggctattggtgatctagctacacaggttttaatcattttttttaattaaatctatttttttttcatattcttggatttctttcaactacctataaaatatccaacgtttcttttaagtaaatgcaaagtgtgctgtgtgccacctcctccaaggatggtttcctggtacattttatgcattgtctcttatgtaataatgagcttttattcattttttcattttctattctgcatcaacctgtttgtgttttacacgtttaagtgtggattgacacccttattaattgttcatgataatggttgaaaattactccttttactatgttaaaaactttcagggatatcaactataattagtttttttttttttaaaataattttcccttgaaacagtattttgcagatcgagatattttctgtgctggtcgtgtagctgaagaagatctaaaaagggttgctgctgcttctggtggaaccgtacaaacatctgtgaataacattattgatgaggtttcacattacttgtgtaactctgtcgtgatttgctcattttctgtaattttatgcattacagatgaacttcttgtgatttatttgcttgaaggtccttggaacttgtgaaatttttgaggaaaggcaggttggaaatgagaggttcaatattttcaatggatgtccatctggccaaacagccaccatagttcttcgtggtggagctgatcaggtctgttatgtgctgtgcaataactgtttatgaaacttgtagttgaactcatgtaatagctctggtaatcttggacttatatttgatatctactattttcttacagttcatagaggaagcagagcgaagtttgcatgatgcaatcatgattgttaggagggctttgaagaattcaacagtggttgctgggggaggtgcaatagatgtatgtgtctaaaatttgtaggtagttatcactgatttatattagtcaacttgttggaagttaatatgtggttcttgttggtagatggagataagccggtatctgaggcagcatgcacgtacaatagctggaaagtctcagcttttcattaactcctatgcaaaagctcttgaggtaactgttttggaatttggcacaatcctttttatgttattctagtattttattcattcaactttgttagtaactcgaggcaatgcctgtttgacacacaagtggttttgttttggcactaacgacgatctccatcaagaacttctcagcttaatggtcttaagtttaaactaataggattcctagctattagcaatgtgtttctttaatgttgttttttccaaattcaacgttaatgccattaataatgtgtctggtagtcgatccatatttaacaatgcatagcaattctggaaaatcttaagggcggctctcacttctcagacattttatccaatgatgaggaactgttcaatcatatgcctccttactgtattactattggggaagggttgggagaaaaatcctttgtgcatgtgttttacatggcgcaattcaacctgaaattgacacattgatatgttcctttattttaacattgtaaaagtagaagtgctcattgcatttgactatttgagacattaattgctgtgctggatgttggaggtctgtgagcatgggattatcaaatgacgtcttttagcaggctataactttttcacattagatgttttgaaattgcatcccttagtatttggttttgcatgaagacttagggtactgtaagaaattagacctgaagggtatggaatcatgttcttccactcagagtatacttgattgttttttttatgcaaagttatggtattactgcaggttatacctagacaattatgtgacaatgccggatttgatgcaactgatgtgctgaataaactaaggcagaaacatgcgcttccttctggttggttggccatctttttgtatgcatgcagtgtgcttgtttacatagatgtattttatgattactggcatgcatgctggcatatactcatttgtctgcttgttacaggtgagggggcaccctatggggtggacatagcaactggtggaattgctgactcatttgctaactttgtctgggagcctgcacttgtgaaggtatctgcctgcatttatttgcataatgtcctgattctgatgttttatgtgcatggtgtttaagttagttaacatttttgcagatcaatgctataaatgctgcaacagaggctgcttgccttatcttaagtgtggatgaaacaattaaaaatcccaaggtaagtttagttctgttattgtatattagatgaggattgtgcttctgttcataacttatttcctggagatttgcacaatttgaaggaattattgatttttattatcatattatattatgtattttctaatttcacgttagttatttctctgtttggtcttcatcttttggtcagggattttgtattttgaaagggtaatgctttataaatttaccttttgatatgtgcagcagcagcacataaagaattctctgcacaaatcctcttgcaactcaattgttttacacttgtctcttttaagcattgtacatatatcactatgcgttgaggaatgagtactagtttcatgcaaatttgttgtacttgttttgaaaatggtatccgggtctctatcgattagcatattccgtgggaatggtatcctccttctactccatgtgaatggggtttccatggtttgctaagggaagagacagtaagggcttcattcctcatctgaattctttaaagacaggaatcaatattctctttattggagatgtgggaatgccgttattggtgggacctatgggatagagattttttgtttcttttcctaacttaaatgcttatgctcttacaaaatgacaaaaaaagttctctcacacgaggtacccaaattttttagtagttttacaaaaaatttgtgcccttgccttgtttcctgtcaataattattatttttaaagtttgacccaccttagttggattgagtgccattgagttttaatgcaactacattccctatacttgaacttgagataattggttaagttagaagttgtaacttattcaagggacaaacagagagagagggagattgtggacaattttggtattgttgcaattgttctacccggatctatcttgtgactatctgaatgttacattgattttcagaaatatgttatgtctactaactagatcctcttttattcttaatgtaactagatcctcttttattctggctacttccgttatgcagctgattttgattttgtctatttaacatctgtagtctgaaagtgcacaaggagatgctgctgcaagtgccatgggcagaggtcgtggaggtggattccgtggtcgtggacgaggaatgcgaagatgatttgaagtgcattctacgggttgagtgtctgttttaattcgtgaggccaatgcatgcttgtttcttctactaggtgttgctggaagcatgccgatttttggacctacaaatcatgaaatgaaaatgtaatggagattctgggaaacatcatctgatcaacctaggatttgcagatagcaattttcaagcattgtctttctgacgatcgttttatacattgggagggttaaaactatcccatggctgtggaggacttgagttcgtgtgaaatttggaatcttcttctacaattttcacctatttatttattacttggtatgcgtatagtataaacatgtgatttcagggtttttttttccgtctacaagtcattagtggggatgtgtacggatatgggctactaaaattgatattcgagtagttgtttaccgtagtgggtaattgctatcactcaaaagtaagtgcaaattattgtatttaccaagctacgttaaaaaaattgaataaattattgagcacacaaaaatggatttatggttcatgccgtgataaaaatagtaataacataatattataagagaaaaaggttatgcacggtaaaaaaaaaatagtcatttaatcataggttttatcaataagtttcttaatttttaaaataattatttatgattgaatgataatttaaatttattttacaatatcaatataattttacttataaatatactttaaaaaataaattaacaataaatagtaaaacttttatttcactggaaaattatttatgttttgtaagataaaagattgaggctgaggattaatactttatgtatggacaatccaaggagttcagccttgaaagtttgtaacagccaattctagcttcataacctcgtgctagacaccatatcttcctagatgccattcatgttctaattcattaatcatgggagtaaagcactagatttagattagtccttgaaattaagttaatttaattctgaattttataaaaaagaaattttagttaatgacttttataactgtcaatcaatttaattcttaaaattgacgctatcaattaatttcgtctgacattataaaatcaattgtttttttttataagctagaatcaattgtttaatccttgaatttgacaatcataattcataagttcatttaactattaggaaccgaattgactaatgcccataaaaatcaggtattacaatgactataattgggaaatttagaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactagctattacagttgaaagttcaagatcttataaactccaccctagaatctcatatttataatgtaaatgattcagtaacaaaaaattaaaaatgctattgtatatgatctattagacttaacagaagaaaattgtcgagtacacaatttagatatagattaagcttatagagataaaggtttagactctagagagtaattccagttgtacacactgaagactggtaataaatcaattcttagatggaattattatgattttgctatttgtatcatttaaccctgggtgtgaagaaattgaccatcgcggattttcttcttgagttatatgttgtaagaaaacaagaactaaattattacttatcctaattgtgttgtcaaactatatataaaaaaacaactaataaaaattaaagaaaaaatatttcatgattacaatgaattatcgccccactacatgcgagaaccaaaatgttagcaatctttaagtatgaattgcaaacaacgaagctattagcagacagaagatataaatgcacataaacttatgtcatagattcagtcgaaaaagtaaaggtttttgttgggtcaaaggtttgggctaagaaaaagaatcaaggtctacggaagaggatttatcaaggcacgactttatacttcatgctgcaaatgaaaaaaaaatactaataagcatcagacaccctaaatgaggaattttttgtatgaatcttccttcacatttatgacagctggcaagtattttttttatttttatttttttgaaaatgagaaaactaataaataaggataaaaactaccaaaggagtatgtactacatgagcatcgaaaatttgttcctaaatgtggaggaagatcattggttttgactcttgaagcctcaccattgcatagtgtatgagctacaaaattgaactttaattttctaaaatgattaatgaaacattggagacggtaaaaggaaatagctaacagaaattaaacagcaacaagatgaagattttgaagaagcaagaatcctcagaactacaatcttaatgattacaaatattctgcagaaaactgattcagtaatttggcaatttacttcatagtcaaaagcattgcaagacaaatccatatctaataaaaagatatcacgaaaattccattatgctacaatttaaatctcagaatcctgtgagcagagtggtgacttcatcagttgctttggcttctacaggaatgggggcaatattacccatcgacgaggatacctaggtctaccttcctttccatcaaataactgcaggttcatcgaaaaagataagacacatgattcatgattataagatgcaaaaaggggaagagactagtagtatgttgggaacacgttttacaaccaacaaatcatgtccttaatatgaaaaacataaagatagtagcattcattttgatgttaaaaaccacgtgcttgatccgtctccaaacatgctgtaacaatattggttcactttatagtatatgatatggtttcaccccatacaaatgataattttataaataaataaaaaatgcaaaatccatatgtagttgaccttggcataaccaagcaataaacattatattcttacaagaagcagcatttttgaatccacatgtttaactttaacatagaagcagaagaaacaacatgatggagtctgaaaatcaagttagccacaaacctttgaaatcctcaaaatctaaaaccagacagtataggaaaaagcacaatcaagttattcctttacaagaaagttcaggtggagtatataatttgctcttagatatttttctaagactgtaaaccggattagtgagctgaaatataaaaggtaaggaggcataccttctctaaacgcctgtgcttggctaaagcccaattggtcatgataaaagtagcaaccacaaggaaaatatagcctgcaacagtttgcgttgcaatgttgaatcccaaccactgatagatctcggttgtataatttgcacaggtaacaatattgaagagaaagccccttgggatttggtatccaccttcaccaccaggactacgaagattcttcagaataatatggcaatagaaatttgaaatttgacaaagtatcccaattccaaacccaatcttcatttgaaggtcgtttacaggggtatataaagggtggttcacataataagcaatataggagccaaaggtccagtaataagcacagttacgaaacacattggaaaggggtgaggttgcatggctgaagcgatgcacaaaaaatgtttccagaattcgtttggcataatggaaacaccagtagtacaaggcatatgtctgcacaggatggaggacacgttcacctttgtagccaaaatattggtagacagggagataatagaagactggatagagaagcaaaggtcccaaatactcgcagaagaaaagtgtacggtaagaaacttgtgggcccaaatccttgaatacaacagttaaggtttctgaatttccacttgtatagtctttcagactctttttgtaattaaggacaacaggcctttcctttgatccggattggacaggaagtgtcaagcgctgccttgatgggtgcttcttggctgtaagtgaaacatacaaatcatgttaatgatctatgaaatccaatggtgcctagagacacagatacacttacagataagcatttttttttcttccaagagaggtactaagatggaaagacaaagccatacaataatagcgggagttgcatgcaggattgaactagtgctgtcatcaatatttcattttatttcaccacccaattaaaattgggttatgttttcataagctgaggaacattcaaatatttctattcaacttcaacaacctagaataggtttaactataaagctactgacaaagacttggatctataatctaataaacaatactgagactcaatgctactaggttatcatcctgctataatcattaaaggatcttaatttatgaagcccagatactctaaaaaagcaaatgtatcggcgtccaacatgtacccaataccaaaatggctaaagatactgctgagaacctcagaatacagtttcatttcaaaaagacatgtagtgtatttttttgttaaatttcccttttcatgtaggttgttccaaatcgtgttgcaaaaaggagcccccatcaccactagggcttgcaaacagcaagtccaaaaccaaatgcatcttccttctcatgaacaatctcctgcaagtatctgcattgctgaagttgctggtggttctagctcctcttttggttctctctccttcgctgggtgccggtccgtgttctccaagttgttattgctattgtgcatttttggtaatgtatcatggttttgtcctttttttttttaataaaaattttatatctgtatctgtatcataagcatatcatattatgtatctgggattcttggattttaataaatactacatagtaagaatgataaacgtcaatgaacatcaggagctgttgttatcaattatcatatcactcagtgtaataagttaaaatccatcacaagtaaaaaacaactaaaaccacatgtacaactaccttagtatccttaggctttgtttgggagttaggaggggaagggaaggaaagagattcaaggggaaaggaggagaaggaaagggaggaaaatgagggaagttccttcctccttgtttggaagttaaaaatatattaagagaggaaaatggagagttaataagatattaaatatgaaaatgatataatttaaatgtaaaaatatattaaaaatatattttaatatatttttgaatgtgtagctggagtaggatagtaattttaattacttttccttctaaaaatccccaaattgggggaactacaatttgtagactttggaggatttcagaggagttttaaaaatcctcaaatcctttctctcaaaaattaaaactcccaaacaaggagatgtctctacctaaacctttcccttccctctctttccatctaaaatctctctcccaaacaaagccatatatgcccaagactaactggatttcagttattttacatctcagacattactttaaaaacaaagtaatttatacataagcatagtagagaaaatgaataagttcacttacttcgcttatgaattgcctcctgcagatctgctacagtagcctaaaaagaaataaagggataaaccataaattattactcttgaaaacaaagtccccttttgccaattgaaaagatagacaaaatgaagggaacttttccgccatatagataaaacctaactctccaaatcaatcgagatatcaaaatccaaaactaccatgaaaacaataaaattaacacaaaaaagagagtaaaaaattcagagggaaaaaaaagacatacagaatcgctgagctcaatgccacctttaaccacttctcttccactccgagaaaccactgtgaccttcatctttgcgaatcaataaagggttactgtatgcaagatccaacagaactaggggtctgaaaatagaaaaaacgaagattcagatcagcagccaaaaacacaatgcaaggagtgtgattttttacacgaagctattaaattaacaatcatgttaatgtagcagaaaaccccacattaaatttctaataattattgcaaaacaatcgtcaagtttccaagcttttttatttatttagtaatagtgtggaataagaagttagcaaaagatacgaactttgacgaagaaagtcgggattcgatgataacagagaatgtgagtcacagcaaaattaggcaaaaaaataagaaaattaacaaaagctcgttgctgagaaatgaatgacccaattggaggaaaagaagtaaggaagaagaaaggggaataatcacctgaattggacagagagaggtggtgttggtgtgtttgcaagttactcgcaaacacaaatgaaatgtgagcttaggaaaattgaaactcagatgtaatatattatatatagattttagatgggagaagataaattaatgtgaagtatggtcaggagaagatgaagccatgcatatgcatacattaatgtgatgcagttggggttggacagctaaccgttttggctgataatctataactcaccacaaattgtaacaaagttccaattggttttgtgttgttgaaattgatggtgaaaaaaattattttgaaaaaatatatttgtatttgtgaacaaatgatttttctttaaaaaaaatgtaattttcttatggaataaaaatgtaaatataataatattttttttattaatttatgctcagaataaattattattagtgaaacattaaaaattcacacttctcctaaaaatgaaaaagataaattaatgtttcctcttacctttaaaccttattaatttatggtcagaataaattcttatttcttttatagcattttgctcaaatggttaaagagaaacagtgcatcgagttctttgcaatggttaccttgatcctctttttctagtatctcaaagcctagtgtatttggtttggggagtgtaaaatcataatgagtgaaaaatcatacttcactacaaaagtaattatttgttgcttctaaaatttatattaagttcaattcaccaccaatttaaacacatactaagagaattattgagtataactataaaacatgtaaaatccatactagatcttacaaattgtacatcctacctcttccttgttgatagttctcccctttctcgttagaatattttgataatacattttggtctctttttcattgtttcagagtttttgtaaaaataaatatttcactactttctttcaccatgtatgatgagtaaagtttaaccgataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatttcgtacaaaatagtgatattgctttttaaaaattagttctacttaatacaaaactaattttgacaaacacacacctcaatatttttagcgcaagcttgcatttgcttgtaacaaaacaacctacaattcatccagatttgatctttccatcttattatttttgttgcgttagaaaaaaaaacataaaataaatatattatatttattatggcccatggcagcgcgtctcaaaacagtagttggatgatgaaatggttgtgcatttactaactattacctactttattatagtccacaggcttctgcctaattaaattattgtttttgaatgcattttgtttacctacaattgcctaattaaccattgatttcgtgacttgttgttttcttttggtcagcggaggaagggaattgagaaacgataaaagggtccagtgaaaataattagtattcactccataagctgtgtttatttcaagaaaaaacaataagaactaagaaggatcaaatttatgtttcttccatcgtttagattgcttgtaaaatggagagaaagagttaaggaacttaatataattagttaaacaaggtgtgagttgttataaactctttacactatttttaatttttacggataaaacaaatggtctgcccaagattaaacaaagaaagagagatgagaagaaaattaaagtcaaagagatatagaaaatattgtttacattacataaatatcattgttggaaattgaatcaatctgttagttttactaagcaatgctatatacaaatgaaaataactcccgtcacaatttactattgagttgaaactgaaactgatgctaaaaaatggaaaatgagttgttagggttgatttgaggtgtggtttgcttttccatcttttgaaacaaacttggcaatcctatcaattgttggccgaactcaaatttcttaacttcatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattcttcaaatatttctcataaaaactttactagtattttcataaccatttccttttcccgtgtatccaagtttgtttgacatttgttgtcttaaaataaataaataaatgaattgaatgccaatgatttttttattgaatcaaattagatttaatattatactcaaatcaaactgcatcacaatttacttttatgattagattgaatgatcttttgttctgaaaccaatccaaatcaatttatgataacccctggcctacttattatcttgttccaaatcacccaataccttttattaaacacaaatttgtttgagcaacatcaagtataagaagcctttaaataattagtgcaaattctggaaatgatcttcatatagacactgtcaaagactcagtcgtatgttaaagattggtgagcagtttatgacaagtatgcttacacaagcaactttattatatcattcaaattctaaattctaaatgtaacaaatcacagagccttgggtgataaaatggttgtaacaagctcatccattgctctcacagatgaccctttttctttacctttctctgttttggcctctctaatgtaagctgcaatctcatttgccttctccttcatctcctttcccttcccttcataatccataactatttctattgtcttcttaaccttctccctagaaaccacagtttccgtagaacgagtaagttccacagccacacccatttcctccaccaacatcttcatattataaggttgatctgcaacaattggccacccaatcagaggcaccccaccccatagctgagactctccaacacagagttccatccacaatggctcagaaaagctcctgtggaagtgtgtgacagaatctccaactggggtccccatttgtgcaccaaaaggccacgtttggtctctctcattctctcttcaaacccttttggcaaccattctgcactgaactctccattgatgtcaaaaccagcaggtggccttataacccaaataaacgatttcccactctcttccaaaccctcagccaaagccatcatttgagatgcactgatagtgttcagtgacccaaatgaaatatagagaacagaattctcatcctttgaatccagccactcaatgcatgcatcaagagctatgccagtttcctttcctgaacgatgttttgaacccatgagtgaagcaggtggaaggagaggccccacggcccaaacgggaagttgaagatagttcctcagaagctttaaccccaaaggctctatcttttccatcgtattgcaaatccacccatcagacttcatagaaagttgaatctgtggaacgaggaatcctgaccaatcatcagtgccatcagctgcttgaagaaacatatgcaattgagttctgtggaaacggtagttttgagggaaacccggaacatggaactcatcagaatcagttttcctgtgagggaggttggaccagatagagatataggccaagattccataagcaccacaagtggtgaaggttaggttcctagtgcctaagctctttgcaacattgttaacccaaccaaggaacatgtcagatattatgcaaagtggagggtgaccctcttcttgtgtgatctgagatatcaaggagcgaaaaggaggctcaagggtgagtgatgcatagccaagtttcaataggtcagtgagaggagccttttgtgtgttgttgtctatgttggagtgttgggtagagttgaagggtactaactcagcaagatggatttgatgattaggagaagtagaagaagaaagtgcagatcgaaggtgttgaatgttttggggtgtgttggctatggtgatggtgaagcttgtgttttgttggatttgtcttgctagtgcgagaaatgggatgaggtggccttgtgctatgagaggtaccatcacgatgtggcctttgtttggtgtctctgccatgggagcgagctcgatcgaggaatgatgtgctacatcctgcgctgtctgtggtataagaacactaaactcaactcttgttgtcttggtttctgctaagaagtgtacaaaagaaatagcaaagagcctgagatgatgaagtaacgtgaaactcttgttgtcttggtttctgataagaagggtgcaacataaagcaaaaagagccaaaaaaaactatctgaatcaatgcactcaactacctatgcatgttgaactagaccagcttttcgatgctgcgggacctgacctgactacccaagaagggaaagaaaagttataaacattagaaaaactagaggaataaaaaaatgcatgttggccatttaagatggattgggtggaaaacaaaattaaaaatagtataatttacttattaactaatctccaacacagttgaatcaaaataattaatttgtaaaccaaaaggaaatcaaatattgctattaaaaacttgagggtctaaaatcctaaatttaaaaatataggagattaaaaatgtgatttagcctaaaagataatgactcagacaaagatatttatgcacactcatttttttttttgaaagaatttttttttgtcctacagttcatctcaatttattattttctcttctttttcattttttcatctcaatttttatgtgcacttttattatgtgttgcccttcgtgaataggaaatattttttgaacacaaaaagtgtgtaattcaatgttactgcttttgtaaaatatatactgtaattcttttatattattattcaattatatattaaaaaatgtgcgtcaaatttccttttaagggggaaatctttgaacgttttagaataatccatcatgttggccttagtatcaaagagcttgaatgcttgaaagtgcttcttccagccatgaaaagtttactttttaaacaaaggaacaacttagacggacaattaagacatgatttcaatgattactttattattactataattagagtagagtgtcgatgtatccataaaattcatattcctatttcataatccaataatttcatttttgtttgatttctttttttataaaaaaaatgaatatatcaacgcatagtaaaaacagagctactattttggatcactctcgatgggtttagacttacattaaatggaaagacaatgtgttgacctaatacctaatacacgtcacagatcaaaaaccttatgagcctacatcaagttgtcatatagcacatgagtgtttatatataattttttttttaaaacaatttatcatttctcatcacgtaataataactacctcaacttttataaatttaatagcacttattacaaatccaagatgcttgtgaaggagtatttatcttataataagttttaagtaataatatataaacatctcatcattttaaatatttcttcaatatctctttttttttttattttttttcttcttatcatatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatttatatcatttttccctctccttaaatgttaaataatacaataggtgtctatgcaactttcataagtttttttaaagtttgacccccctagttatacctcttttggttccattccttggataaatggttccctatctcttgtatctctttatcaatcaataatactaatctgttttcattctttctgtacactctcttcgagaatagtaaaaaagtaaatctcatcccatccttggatgtaacattatagattaatagatatagatagattagatagacactataatcatattggatattgcaaacaagaagtgcagattttgcatttgatatagagatcgagaagggaaagtaaaacaattctgaacagggaacaagaaaacaggaacacactggttataaaaattcagcacttttgatgatataagcgaagtagtaggatgataaaagaatgaggaatgatatatctaagttatcgactatcatttattttaaatgtttcattattatttaacatttttttttatctttctcatctcgtcacatcataaattttattaaatttatactttccttttctgtctctcactgggcatctaacttaaaatattttcctataacaattcagcaattatgtcaatgttaatatttgataacaaaaaatttaaaacactcaataaacaattcttttttctctttatctctctttatattacactacatcattaattaaataaatcacctatctttcatctctttccttctctctcagtaaacaatttaagctacactaacttcatcctcataattaatgattattatatattaaaagtttatatagatacgtgtgcttgctgagatcatattcattcaccttttatgctgaactcaaatcatcaattaaaatgagttaaatgattatcttcatagtgacaatattaccaaagtcttgtgctaaagcttgctgagcagtgcctaacaagtatgcttacacaagcaactttattatcattcaaattctaaatgcaacaaatcacaatgccttgggtgataaaatggttcttacaagatcatccattgctctcacagaagaccctttttctttacctttctctgttttggcctctttcatgtgagctgcaatctcagtcgcgttctccttcatctcctttcccttcccttcttgctccataactatctctataaccttcttaacctgttccccagaaatgacagtttccacagttcgagtaagctcaacagccacacccatttcctccaccaacatctttacattgtatgcttgttctgcagctagtggccatccaattataggaaccccacagctgagactctccaacacagagttccatccacaatggcttagaaatgctcctgtggaactgtgtgacagaatctccaactggggtccccatttgtgcaccaaaaggccacgtttggtgtctctcattctctcttcaaacccttttggcaaccattctgcaatgaactctccattgatgtcaaaaccaaaaggtggccttgtgacccaaataaacgatctaccactctcttccaaaccttcagccaaagccatcatttgagatgcactgatagtgttctgtgacccaaatgaaatgtagagaacagaactctcatccttcgaatccagccactgcatgcatgcatcaagggctatgccagattcttttcctgcacgatgttttgaatccatgagtgaagcaggtggaaggagaggccccacagtccaaacgggaagttgaagatagttcccgagaaggtgcaaccccaaaggctcaatctcctcaaccgtgttgcaaatccacccatcagacttcatagaaagtgtaatctgtggaacaatgaatcttgaccagtcatcagtgccatcagctgctagaagaaacttatgcaatatagttcggttgaatttgtagttttgagggaaccccggaacgcaaaactcatcagagtcagttttcctgtgagggagattggaccagatagaaacataggccaaggttccataagcaccgcaagtggtgaagcttaggttcctaatacctaaactctttgcaacgttgttaacccagccaaggaacacgtcggatattgtgcaaagtggagggtgaccttcttcttctgtgatctgtgatatcaaggagcgaagtggaggctcaagggtgagtgatgcatgacagagtttcattagttgagtgagaggaagcttctctgtgttgtctatgttgggtggcaaaccgtgaagagtggagttgaagggtaactcagcaagaaggatttgatgattgggagaagttgaagaagaaagtgcagatcggaggtattgaatgttgaagggtgtgttggctatagtgatggtgaagcttgtgctttgttggatttgccttgctaatgccaggaatgggatgatgtggccttgggccatgaagggtaccatcaccacgtgccccttcttcttcttcttctttggtgtctccgtcatttgaacgagctcaaggaatggtatgtgctacaccctgcgctcagtgcgctggctttggtacaagaaaatggttgttgtcttggttgctgtttcacaaaataaagcactgagaaaaaggtgaatgaagaagtaacgtgacatgctacagagtcatagcctgttaggcttcaactttccctgtgccgggaccattcaacacctatttattttaaaattcaattaatacattttattttctttttcttcttgtcacgttatattatacttcatatttatatttttctctcttttgtcatactgttagtgtaaaatgacatatggatgtacaattatatttttcctaaatcaaactagtttttcagtgtgtcacgacttgactaccttagaaggaaaaaaagggtaaatagtttatttagttactaaattatgcattcgtgcgaataatttagtctttgcatttttgaaataatcaatttagtttataaatattgtgaaaaattaatttaatcgagtcatgtatatcgcatactaatttgtcaataaataatataatgattactctaacattaagtatcatattttaaaaaccaaattatcattatgtaatatagtttcaatgtaatataatttcaaaatccactgttaaattaaaagtttctttcctgtatattatatttataaaattttatattaataaaaaattatttgaaaattcatatatatatatatatatatgtatatatcaaaattgacatacaatatattttttaaaatatattaaaatataaattatatgatttcgtttttattgatgttcaattttcataaaatttagatattataaatcgtaggattaattggtattaatggtttcaatttgatgttaaccaagatagaaaaataatacagaatcgccttgttctagataaaatctaaacatggccaatacatagacgaaatcacctatacttatagagcgagcaggccaaatccaaacttgttctaaaaagaaagaaggtacaaggaaacaaacaactcatgaaccatgaaacaaaacttagtcctctaagtaaaagggagaaccgaaaaagaagaatacaaagcatttggagatttcaaatttattagaaaagtaagagccatacgaataggtcacccaatttcaaatacgcaatgtgagtcactatggtttaagcccaaaagaaacagaaccattttagcctaaattttttgacaatgcaaagcaaactcattaagtgtgggggcaactattcttgtcctcagggctaagggtttaggcctacatcaaaaaggaaagataacacgtgggtccaataccgataagacccaatatacctaacaaattatatcaagaaccttacgagcctaccaactccaattcaactatgaagtgcaatatctgataaaactaagttaaacaatgaacaacgaaaatcacaagattcactcctaaaacattccccacttctcatcacataagtatcattacctttaacgtattggggaatattataaataagtcaaagagttctcaagtgcactctttaacttctatactattaagtattagaacctatttggatataagacaaatatttttgagaacttttttattgaaaatataatatttttttcattagaaaaacttttaaaagtacttctaacattttatctaaacaaactcttaatctccttttggtaatactgacttgtgacttgagtatcaaaatccctataaatactttatcgaagttcaactcatgcagaccgagaagagatttcgttcaaatacccctccttctaaaccaatgtcaaaggcaatgtgaaagatgaaacatgattgtattgctttgagatgctggctagcgtagggcagcttctcatgtttcacaccctgtgagacgtttatgtaccgtctgatatattatttacaaatccaatggttcgaagatatgatggttaaccaataggatgacttgctaaatattaatttttaaataataatcagaatttttaatatctatatttaccttaacattgtcatcaactttgacaaataaattggcatcccataagtttattgcagcaaagtaggattttgtctttgatgacaatcaatttatccttcaacatgattatgcataaacaaagtatgaagaggtattagatcttgggatgagtttgtttaaactttaaaaaaataacttaaaaaataagtattttttaataatcatataagatttgtttcttaaaataaccaaaaaaactgttccagtatattaaatgtcttgaaatttgatcttatgccaacaacaataatcattcaattcatatcacctgtatcaaatatcaatgtcattcaaccagcctccgtccctctttggtcagctgcgaacagaggttttacagaagagaattagcactcacaactcaacaaaccccttcatatattgaccactcttaaccggaataatggaacaaaaatagggactcaaagcatgcccatatacactcatcaatctcaataaacattaatatcattactagagttaaccaataacccagtcaatcgttagtcaattttctgttttatcaaattagtttgttacttggtcttctctaggttagcttccaatccttggatgtaacattatagatagattagataggcactaaaatcatattgcaaacaagaagtgcagctttgtatttgaaatagagagaagggaaagtgataagacaataaattctgaaggtggaacaagaaaacaggaacattatggttataataattcagcacatttgaatatttgatgatacaaaccaagtagtaggatgatataacaattcagcactcatgcaagtcgtgttagtcttttcacatataataagttgctaattaacactttgaaagataaagagaaaaaagtataagtatgttgaaattgatggaatgtttataataaaaaggtgttcatatattacttcttatatcataaacatctattttgatacattttccccctgtcaaatcatattatttcacttcttatctctttctctctctttaggtgttatatatctaatagcatagaagtgtgtttataataataaggatattcgcatatccttactcaaatcaaactagcttttcggtgctgggggacctgactaccttggaaggaaaagaaaagttataaacgtccgccctatctatctatttggtttgaaggagagagaaataaggaaaataaaaggtaaaattaaaaaattatcttattaaattatatatatttgataaaattaacttatgaaatgataaatagtataaaataatagaaaaataataaaattataatttatttaaaaatggtaattagaaaattagataaatatattgaagataaaaattgaaaaaaaaaaaactaaaagttagtatttcaaaaaataataaaaattatgaaaaattactaaaaaattatttactgaataatcaaataaatttttgaactaataaaaaaattaaaaataaccttaaacgtcttgtggagccttagtcacacaaggttaaggttagcttgtttggctgttggctacataattttctctcttgatgagtacattatacgtctacccaacaatttcaacaagttcaatataatacctgtagcacattacttgtttttattacaatttaattcattgttataatcacttattcatacattactaagtaacagtacaactaattatttcccaaggtaatacatttcatagttgataaaagttctaattatattgctaaagctaattaaacatgcgtgtgtaatcttggataaactcaaatccaaacatagactagattcccaaacatataaaaattgatactctgcatattcttaatattgcaccgcacgtactaattttgatttcctgcaacttttttataaagcatttaagaaacatctcttaaaataaaaactcttaaaagaagaaaaaaaaaataaatattctcattagagtaatcacatatatacatttatactttttaaacaaataattactatttatcattattatttttcatatcacatcataatatttaagattattttctatgacaggatgtataataacatattcggtattccttttccttggcattacagtttcctatgttcgaaagacacttcccgttcacgaaaggcctaacatattcttcctaagcatgtcccacgacaccgaaaagctggtaagatataaattataatatgcaatcatgcacagtgcagtgcatacgtggagtgcagtggttcacgtttttgccgaacactctctgctatgtccatatgtctacttcatcttatgctttaagttgaataaatactcgttttcgttttagtcccgaaagtgttaaagtataaattgatccagctttctggatagaattttttttttttaatttaattaaaatatataaaaaaatttgtaacagattcatttgattaatttatatggtccggcactttcagcttcaaggacaaaaaatacgtatttatcctttgtttatagtttatatcctttttatatcagaaacccagtgaagggaatacgagtttataccttaagggttgagctacctccaatggcagcagagaagaaggggcacatcgtgatggtaccctttatggcacaaggccacatcatcccattcctggcactagcaagggaaatccaacagagaacaaaaagcttcaccatcaccatagccagcacacccctaaacattcaatacctccgatctgcactttcttctcctaatgaaatccatcttgctgagttacccttcaactctacccaacacggtttgccacccaacatagagaacaccgagaagctccctctcactcacatagccaaactctttctttcaacactcagccttgaagctcctcttcgctccttgatatcacagatcacagaacaagagggtcaccctccactttgcgttatatctgatgtgttccttggctgggttaacaacgttgcaaagagtttaggcattaggaacctaagcttcaccacttgtggtgcttatggaaccttggcctatgtttctatttggtccaacctccctcacagaaaaacagattctgatgagttccatgttccggggttccctcaaaactacaaattccaccgcacccaattgcataaatttctaagagcagctgatggcactgatgagtggtcacagttcttcattccacagactgcactttctatgaagtctgatgggtggatttgcaacacggttgaggagattgagcctctggggttgcaccttctcaggaactatcttcaacttcccgtttggactgtggggcctctcttgccacctgcttcacacagtggttcaaaacatcgtgcaggaaaggaacctggcatagcccttgaagcatgtatggagtggctggacttgaaagatgagaattctgttctgtatatttcatttgggtctcagaacactatcagtgcatctcaaatgatggctttggctgaagggttggaagagagtggaagatcgtttatttgggtcataaggccaccttttggttttgatatcaatggagagttcattgcagaatggttgccaaaagggtttgaagagagactgagaggcaccaaacgtggccttttggtgcacaaatggggaccccagttggagattctttcacacacttccacaggagcttttctaagccattgtggatggaactctgtgttggagagtctcagctatggggttcctatgattggatggccactagctgcagaacaagcatacaatgtgaagatgttggtggaggaaatgggtgtggctgttgagctcactcgaactgtggaaactgtgatctctggggagcaggttaagaaggttatagagatagttattgagcaagaagggaaaggaaaggagatgaaggagaaggcgaatgaaattgcagctcacttgagagaagccataacagagaaaggtaaagaaaaagggtcttctgttagagcaatggatgatcttgttagaaccattttatcacccaaggctttgtgatatgttgcatttagaatttggaatttggaatttggaatttggaatttgaatgatataataaagttgcttgtgtaagcatacttgtcatgaactgctcagcaatctttaacatttgactttgatcatgtcactgtgaagatcaaaagtacactttttttaattgatgatgatttgtaaacaaaaacaatatagaacgtcaatggatatgatctccataagttaactttttagtatataataatcataaattgatataactcatgaaaaccattaatatatgtgtataacgcaatctctgcaagtgcacatatcgtcctactacttcgcttatatcatcaacaatactcaattattataagttacagccattattcctgttttcctgtttcgccacgtttagaattgttatcttaaagaaaattagtataaactgtattaaacgtgtttttcattgaaaaatgtaaaattttcattctattaatcaatcaaaactattttttatcagtaatcaaaattatattaagtataatttttaaaataattataataaaagttactgtatattaaaaattataattgaataacaatgtaaaaattatttacacctccagtacatttaaattcattttgtattggaaaatagcatcattaattccagtttggtatttgaactcaaaattacccttcatatatcttccagaacatgccaaccgcatcgaaataatgactatcccgtttataatttaatttttttgaaaggctgtttacacttttacatccaatgttttttaatatatactaaaatgatttttttgtgaatagttactattcataaggtaattttgtcaccaaactaagatatgatttctaaaatttcactaaaaaatacctgcttttgtttgcctttttttctcccaaattcctaaacccatttctactcgttattcgttcggagaatgctcctccaccccggtgactggaaaggattttccaaacggttcctataaagtaaatctgttgcctatgatatgatacatgtacacaaatattttagacaacaaacttacaaaaaaaaaagagaaaaagacttcactacgttttctaagccatttgtgtattcagtggtcaccacatggccatcacgaagccatcttggtatgaaacaaaaatttgccgcttcacttacgaggcctttttgacataggttctgtctgtacatcaccctgtcaaatatgaggttttaggttaaactaaaataaattataacaagaaaatgaatatgtatgcaaagtgttctcaaattgtaattgtaatatacaagaaaagacactgaaataaacagagattttatcgggcattattacgggtgtgcttgattgtgttctctttttttttttttttcaaaattattttacaaagtaacatgcatgaaatatttttcagaagaaaataaaggcgaaaatgagaacacgaaaagaaaaattaacacattgattcgcctggtggcacttatttaggtaacagaaaacattgtgtaaaaagaaaaaggtaacaggaaacaacttacaggacccaagagttgctcacggatataggccattgatcgtagtacagcacccagtgtgtccttggtcacctgaaacttaacttcacttgcaccagaagtagtctccgcgactggaagctgaaacagtttaaagaatttcaacaatctaaaagtttgtcgaagtacatagccaaaaatcaaagaaaacattttcagaaggtgggatttccatacaataacaagtaacaaacatgcactcaatcccccatacagtaagaaataatacaattgatgacattctttttttggcttttgttctctttatctttccttttattctttatgggaagggggagacacaagccattgaggaaaaaaataatgaaaaaaacaaatgcacacttttttatatggacatatatatgacctatcaatgaacagatcttacatcatttccacaatgatttcaccctaatcaaataaaaatgctagacacatccacattgaacacaatcattactccacatatgtgctcctttcatcaaaatatggcctccaatttatccctatgaatgaggccaagtatttatccctatgaatgttctttatattttaaactgaatttggttaggccaatttaaagatattaaagtaaaaaatcaagtataatgtcatatcatgatattacaagttatctgcctcaacagcatcatgtcattttataaagctacattttcaaccgcatcatgtttgatacattcattaatagccaatatgaatgtgatcatacttaacaatttccccaataatcaatcttattgaccaataccaccatcctctgaaaaacaacagacagactagttctgttccctttcatttgttgccaatttaaataaaactaaaattctcttccttagtaatccaatcaataatatgtgctccttacacaaaaccttaccttataaatataaaaaaaaaaactaagtaccccattgcccaaaggctcctcgctatgcgaaggtaaaggggaggcatattacgcagtcttacccttgcatatgcaaagagactgttttgggattcgaacccataaccaacaagtcaccaatgcacaactttaccactgtaccagggctcaccctcatttacagccattcagtaagaagagaagtgctttaaggaattttaatcatgaaagtgcaaagcagcatcaatccctgcttttctagtactagaatactaaagtaacaaagcatacggctgagaaagataaatatataaggaacaaaatcacacaccttgagattcaatacagcaaacttcctagttggtatggaaagctgatcactgatgttgaccatatggttaaacaatggttccaaggtaacttttgagagattaaacttaacctccgattctgttgaaggaatcctgctataatcttgcaactgcattcaaaatatgtttaaaggacttaggatcctcacatagttgttatttgttaaaatattgcaagaggataaaagcaggacaccctgccacaattaaatgttacagaagatatttatacccaaaaaggggcaaaggttgtttgagtctcaaacttctcatgcaaaagaataggtatataaaccaactctaaactaaatcatgactcatgagcactactacaaatttttcatcgttcatattattatcagcacaccttaagactgataacagctactctattccctggtgttgagttcttgttctccattacccacgtcaatgatttcagacacggataaaccacctacatgataaagcacaaggaagagtttaatgccatgcagtccaattccaatcctaagaatacatcaaataaaaagaagaaaagaggttctccttcacataccatttcaggtggaccatcatctcgctggagagacactggggtcatttgtggtaaatttagatcagcaactgattgaacaggagtactagcatcattaagattaaacctctgtgttgtttcgtcctgcaaaggccacaacagagggtttgtatctgctgttgaagtaggggattttctgtcatcataagcagtcccactgactggatgactgggaggggcaactttggcaacacttctcctcatgaaagaaatcttctttccactttctctaagagcactaattgcagtatcataagtttccacagtcaatgccccttcttcagcatatttgatggcttcccaacaaaggttactatatcgtgatgtcaaagacttgggtccatgtgattcatcagcaagttcaactgatccagcactgctttttgcatttcttgtccaccgttttaaaatgtaatgagatggtaatgtaagtacattagtcacagtaaaaacagttagaacatgtctacatagaatgcctgaatactcaaacatttggcaactacagttagctctcaactcagaaaggtttaatgtgacaacatacgccttttggtcatcctcaaattttgcaaccctgaatatgctattttctccatcttcttcaattctgttggcagtataagcaaaagtttccactaactcttcttgaaactttgaaaatattttccgcgtatagagattagcagcctgcttctccatcggggaaggtgtcttcagaacaggggaggtacaaattgtctcataatctgattctaattctttttcaaaccagcagtccaatgcttgttcatactgcctaaagaacagtggtaatgttgtctggtggttgacaaaaccataaaaaaaagaaccatcaaatccttgattaggagatattgctgcaaaaaatgaatcacgaaaatatgctggaacccattgagcacgagcactgtacaaggactgaagccaatcatttttcgtgagttcatatttattgatgataaaattccaagatgaatcaaactcctcaatggtttcagtcagattaatacaattataaagttcaatctgaaaatttggatgcatgttgcatacatgagccaacttttcatggccttctcgcaagacttgccatttgcttatacaatggcgtgtttgaggaaaaacttgtgaaacagctgcctgtatggctctgtcttgatcggtagtgatagagacagggtaacattcgttcatcgctgtcagaaatgtcttaaaaagccacacaaaagaagcttcagaatcatccaaaagaagtgcacaaccaaacaaaatcatctgaccatgatgatttacaccagtgaatggagcaaatggcactccatattgatttattctgtatgttgtgtccagagtaactgcatcaccaaaatgactgtaagcagtccttgatcttgcatctgcccaaaacacattagacatatgattatcttcatcaagttgcattgcatagaagaaaccagggttctcagcttgcattttcttaaagtactccagcaggttgtgagcatccttccctaatgtcctctttcgagtaggtggcctaacagcataattcatcattgtaggacttttaaccggctgatttgtttcagcaacagcaacagcaacagctgcgggaatcttcttaattccatgaatatttttagtgggaatgcaattcttatccatagatacatacatcataccacttggaacaagccccactccttggtaagtttcaggcatggttcttccaacactagaaaagggcttacgtggccgaatattatgcactttactaatgctagccatggaatggctatgctcctttataaattttgtaacaacccacttattttgacccttcagctcgattctaatcattgcattgcagctttcaggaggctttcttttcgaatcttccctgccacacagaaactcccggtacatatttgccccatcagctgtagaacgaccatgcaggccagctttgcagctgaaacccactcgttttccatactcattgtagaaagtctttgcagcatcttcagaatcaaattccctacccacatatggctcagaaaccccaacccgaacatgagaaccagagttgttttcagcactactaactccaccttcactagattcagcatttccattgtctgccatagcttgacggtcacttccttctcccatgcttatcacttgtatgtagccagagttgcatgctttaatcctataaaatagaaagatgggttgtcttaaattgcctatacaccaagtaaacctcaaatattattaataatagaatgtagcaaaacaaagacaagaaccagtaaaaaagaaaaagaaaaaaaaagtgagcttcttcagattaaaagacaattgtcatttaccaaattaaggtgtgacacaaaaataaatctgtcccatcaaaactgagtcttatttaaagtgtacaataacaattcaaaactgacaggcatcatcagaaatttgacatagccaaaaacaatgctaacggaataaaagtttcatgtcaaataggtttaagctaaacaccataacagcatagctacaacacacaattttaatattcaattaattatcaccattgattatcacaaataggtcaaaacgcatacctagagatgaagtagccaatagaagttacaaaaatttaagtaaaattcacaaaagttaaaagaaaacaataaaaacagtaacggtaacaaaattcagtgtaaaaattaagcgaaaaattggaagtcataacttacagcgatgaaaactaagtgtggtgttaataaagctcgtgaaataattagagtgttccaaatcgggggttgaggaatcgcagaaacgcgtgaacggtgagggaatgagagagagttagggttccgcagctccgggcggttgcagagtcagaggaggaagaagcgtgagcgtgagagtgagtggatgtagtgttgcataggttagatatgagtacacacgtcatccttaccgtttgatctatatcatacggttatgattcgcttagatcgaaatctattttaatgggaacttccttcgtttttctgtcttttgtggtgggatttctcacgtgcactgtgcaccatccatccatcgctgtgggatccacaatcgcatagcatatacaccgtacattttgtttatgattatattttattatttcacatttttcactttccacttctcttttttttaatatgtttttttacatgtctaattttctatttttaattatctttttattatttttgaaaaaaaataccttattattattcaaaaaaaattaaataaaaaactaatataaatttatatctaatatagttatattatattattacaatctctttcatcattaaattaaaattaaataagtaaaagactaatttagcctcgaaatgtcaatacaccattttaaatactcaatatatagatttaggataagactcttgactcaataaaagttagaataacttttaaaaatattcttgttcaaaaaataataactcctaaaaatcctttgttgtattgtagcattaattgtttcatgaaagaaaatttaagtgggttaagtcatagttaacacttgctatttgaaactaatatgttattaagtagaaagagttatgtcctaattatcatttataacttttggcctaataataaacgctcaatccaacaattaatatcataattaaggtcacgagttcgattttcaacagaacaattattgagaaagaaattaattatttgtgaggttgtgacattaattatccttgaaatgaaagtccaagtgagtcaagttataaaaacactcttattcaacaaaaacactttcatttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagaacaaattttatccttttttaaagtttgagtttttatccttttaattttattttataacctttttagtttctcactcataaatttatttttaaaatattttaaaataacggctaagatcaattaagtcaaagcaccttaataagacgtttatttcaaggtataatattacattagcagaattcatattcacaaaaatatcgtaattagaaatattagttttttggggtgagaaattagaaatattattcttccactaattaatatatatacgtaataaaagataacgttattttcgctctaccacctcaatcttattactcatcctataatctcacacatttccctattttatctaattttatttataaaaattgttaaaaaattattatataataatgatagtcattattattatttccattaaataaccattaaagaaacatgatgaaaagaaaaaatatatatgataaaataaaagtaatttatattcgtgtatctattctctgtttgatcctaattttctagtttgaccctcattttcttcctaaatctgtctttcctttttcaaggtatcattgcttctattctctgttttactacctgtttctttcctcctcttcaaaattggataaggacattcataatttactctttcctaaattaaacagtgcatgtgatgaaagcaaagtttaaaaaaattgtcgtacgttcttaaaagaatgttacaagatactattcaggttcccatgatcgctctattttggaagctattcctacttcccttagtgcatctttggatatcaaacaaaatcgattctaaatccaaaagtcatggtgaataattgaaattagagaagcaacaacaaagtgttgcattgctgtgacagtagaaaaataagcatgcatggtgtggcgatcgcaccatctacccaaagtgttgcttttgatcctggctgacacaagtggtgtgtctcttgtatgcataggatcacgcctaagtgcttatagttagttaattctcttaataaattaaaataaacattgtcctatgttcttaaaagaatgttacaaggtattactattaggttaaatgatataactcaacatatgacaatggaatgaaattgaagcacccaagtcaagaatgacaaaaccaaaggatgagaagaaaagaagaagaagcttagagagaaataacatgagcgaaggggagttttgtgggatcaacctcgttattcttttgcataacacttttggaaagcctcaagagattcctgatttggcaaaatagccttggcgttaacgtcatgcatgctcctcgcaaacaaacacctgcatgactcactcgccgcgttaaaaagctccacgtccctgttattctaacctgggattctgcggcggagacggaggtgggtgtggcggtggcttcgtcgccggacattgtgtgtgtttgagagattgagagtaggtacgttttttcttttctctctctcttttctcttatacagatatatgagtttttgtctatgcgtacgtaaatgatggagccaaattaagtaggacattatatttcgctgctgccaaggctaatcataactcagtggtagtttttgttttttgtgagagaaaaaatatattggaaaactcgaaccaaagaataatacgagatcgagataggaaaaaaaaatccaatacataaaactgttataaaattggatcgtatatatgaacacaatatttctaaattattgcatatgcatatcaaaattcagatcaagatgggaaaatttattcattctttcgtctgtatcaacaatatttctaagctcatatatgcgttatgcgtgcagtagtgattggttattataattcattaatacccagagattagactgatgatcgatcactaattctgagtaagaggtggagtacaatattgtttacttcaaatacaaaatcatgagatacacacagtgtgctcttaagatcatcatattaattgggaacattcaatgttcagttgttcattggtataaaaaataagtcaaagatacgaattaattaataaattgtattatttataataaatagatggataatcaaaaagatttaacccttgagcagtgtatatgagtttataaatctcttatgattgttttcgatacctacaaatgaataaaaaataatatatgcacgatgaactggataatataaattataatttatatattgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatagacattcaataaaaagttaccttggcgtcacattatattaataaatacaatgatcaataacagatgtacatataagaattaaatataatttgagttcctcaaatttgaagtgttatcgaagaaatgtgtgcataatgttgacatgtgttcattttttgtaagttagaaatgaaaaaaaagtgttcttaaataaagaagtaagaaaaaacaatttagtaattttaatcatcattatattaagattttaaagtttttcttactaatttactattttaaaatactaattcttcaaaatctaaaatgtcactatgaaaaccacaatgatattataaaataatttgttgataaattaatttttgtgatgtaatattaatttaatattgttttttagatgattaatttgataatatttgttttttttttaaatactttttcttgagttgtcctggaaaaggtagccagaaggtcgttggcatattcctttctcaacctgtggatctcaatcccattttctttctttgtcgtcgcagacattaccacacaacacaaaccctaattgcattttcttaccccaatctctctgctcccgcttcgcttcatcactcttctcaaggtattttacgatctctctcccattcctttcccctctattttcctcctcttaattagatcctttaggtttttctttttgtcccttttgatcacatcaaacttcaatcattcttgtttttcactaattccattagtaattttaggattcctccacccttaatttggacatcgattgttgcttagcttggggttaacttcaggtttcccgattcgttatttttctcggcttcggtttgggaattttgaatttgttacgttctagggtttgagctttcaaccctcttgattcatagagtaggatcctcattttttatggcatctgagtgcccgaatggtactgaggtttatcaaagtttagcacacttaatagcaaatccaggcataggcatagttgaatctaatctccagctttgtcccaaatccttcactgaaggaatagcaacctcaaaatttatgcctgctaacaaacctgaatctgggaagggtgtgaagttaaagggagcatccaagattaattccaagaaaggcatcaacgcccctgtcagtgccttgaactactcctcaattcctgatgtggttttcaattgtggtttgtccatcaccgaccttcctctggcattgatatctgagattctcaattgccttgatcccaaggatcttggtgttgtttcgtgtgtctccacaattttccaaagagttgcgtccgagcaccatgcttggaagcaattctactgtgaaaggtgggggcttccggcagcttccttggctgtggattcaggtgttgtgtatgatgataagtcatggagggaacttttcgtggaaagggagtttaggagtaagacttttatgggacgttatagtattgatgtgttgtatggacatactgaagcagttcggactgttttcctattagcttctgcgaaggtcatatttacctctgggtatgactctgttgtgaggatgtgggacatggagaatgggttgtcaattgcatcatcacgaccccttggctgcaccattcgtgccgttgcagcagatagaaaactattggttgctggcggtactgatggattcattcattgttggagggctgttgaagacctgcctcacttgtttgaacttagagccacacaaaaccagaatactgaggttcgactctggggacatgaaggtcctataacttcacttgctttagacttgacaaggatttacagtggttcatgggacacaactgttagagtgtgggaccgtaattcaatgaagtgtactgcagtgttgaggcacagtgattgggtctgggcacttgtccctcatgatactactgttgccagcacatcaggttcggatgtgtatgtttgggatactaatagtggaactttggtgaccattgttcataatgttaatgttggtaatacttatgctttggcacggagccatacaggggacttcctttttactggaggtgaagatggtgcaattcacatgtatgagattgttagggttggctatgagtgtaaaacttggcatgttgctgcatgggttcctcactcggcctctgtgtattcccttgcctttgagtttccatggcttgtttctgcatcaagtgatggcaagctggctctaattgatgtgagaaagctgttgaggataagcaagcgagctctggggaagagagtttcaaaggtaaagaatttgggtggagacatagtagagcctccacagaggatgttgcatggatttaagtgcaatcttttctctgtggatataggagctgaacgaattgtctgtggaggtgaagaaggtgttgtcaggatctggaatttcacggaagctttggaaattgaacggagagcccgtgcattaagaggaatacgattagagaacagaatgaggcgacggaaactccagacagagctgagcaataaaagtggccggagtgatcagtgttcagttgcagcgaagaagaattctgtcccttgtatttggcccaaacgtgggatgagcggaaagctgaaagcatagtgactgaggcagtctaatgtttgcttatatgcaccaattgacaatccttttttttcttttcaaaattgatgaatacgatattttagtttcaagcaggtaaactgacctgaccactctctttacgtattatgatatgattagtttctgtaggtagtgatcagatcagactacaccactctacatttcaattggtacgattctgaaactgatagtgtttctttccaagaattgttcttacaattttacaggtggtgtttctacaagaattctatatgatgtgcatttgataactcagtattgacattcgaccatcgatttaaacagattcaggatgctattgtcttgatagattgcaggagtgggctcaatgattcttgcttctgagttctatgaaactgatagacgagacgaaagcatttgcacgagaggctatggtagtaatacgggaagctggggtggtgatagttagtcatttatgtttgatgacgagcttattcttagatatgctcattactctccgaatcaatttgttcagtctaatattttcgaagttaaactatttatttggtctatatagttgtctttcattttaagtttagtctttacactagaagactataagttttatgtatgttaagtcttggttcctattgccaacacaagataacattttgtgactgtaaaatttctacaaaacttgcaacattttgtatatggattaaaatttaaaatagaaaccactataaatatcaagtgaatagtataacatgtttttaatctcgtggatgtgtgtaacaaaccaccaatcattttatgaaagaaatcgaaggacgaaagaagcaactggctccagttttttgttttgcagagtagtgtctatatgataggcgtatcatgtttaccaaaattgcaccaggttacacactagttttgagagtgcttatgcactcttcatgaaagaagtgctctaaccccaattctataaactataagctggtgtttgtcaataacagaaatcattaaagtttattaccctaagtcagattagattcgaattatttgtatttgaaaatattatagatgatgttttgtaaagaaaattaataaatactatatttaaatctgcagccatcaaatacaaactcgactgtgtgcagttagaaagacgatcagtttacgaggatttcttttaggaaatttttacaatgacgaggtcaagacttaaatttgaaataggaaaatgataagataaatgagaaaggtaattacaaaaaagtagtagaaattaatttgataatagatttaattagaactaatttaggaataaaatcattctagaactgaaatagtgactaatttttttttaagtgattgatttgataacttatgtttttttttaaactaatacaatctactatataatatgagagaatgtcacatgatagttccatattcatttcctccaaaataataaattcaataataaatacaattgatatcatttttattatttattcattaatagtagttatcttttaaatagttaccttaattataatatatttctttcaggcaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatgcaattgatatcatttttattatttattcattaatagtagttatcttttaaatagttaccttaattataatatatttctttcaggcaaattaaaaaaatattttgcaattaaatttttgcacttactatttaattttattttttttatataagttttattttatatatattttatttcgacaatagtatgacaaattatggtatccatgataacgattgttataaaataattatacaaaattatttaataacattttttactatactaaaatgtaaaccttgcaaataaaaattataaaagattgtattattgatgaaaaatattcctacgtgaatatttgattgaattttaatcacaaaaatatttatttattttaataaagtttcatttcttataacatttattcatgaaaatatttaatgaacatattatttttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatatatttaaatatttcttaaaatttttactaacatatatatatatatatatatatatttattaaaatttaaactaaaaaattaataattatttaaatcttggttgttgtggtgaaagaacagtttaagtttctactccccaacacacacgaaggaacaaacgcttaaggaaaaaacgtgggacacagcatacacgaacgacaatttacgcggttagattgtcaattgttatcgttattcatgattttaatgttcttctaactttagaatttaagttgtatgaagcatcttgtacatgtgaaacaaaaattaaaagtaactaataatgcattgacacgtctcctactacattaaaaaacgttgtttactttatcactattgcgtcttcgtgatgtgatattgagttctcattgctttttaactttcttcttagctagttccgtttcaaagttgagcctacaatgacaggactatatagagatataataaataaataaataaataataaaaagtctaacataatatcttgttttactaccaaaattccttaactttatagaggtaccatagaaattctataataataataatattattattattattattattattattattaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttaattttgtgtttacaaaaataaaatattcaaaactggttactctttttttttgtgccccgttcaatataattgtgacccaaagtacaaaaataaaatataatcattttacaagtttctattaaagaattatcaaacatgttacttgtcattaaaaaatacgaactagagaaataacaaaataaatgaaaggctttgaagcagcgtaggctataaatagaagtttgtgaattgaaatggttgtatccaaaaatcctctctagttatgttgttgagttgaaaggatgaatatgaataagaatgtttggtggcttctactcccatactttctcttccttcttcttcttcttttacttccttcttcttcttctttctgcaaccatgatgacagctctgccttgctacaactcaaatactcactcgacacttcaaatgattttccttccaaaacagaattttggaacaacggaacagattgttgtgagtggcttggggtcaagtgcgacatcatctcaggccacgtgattggtcttgacctatcctttcataatatttttggtgacattccctccaaaatctctcacttgtccaaattactgtcacttgatttccgtagcaactactatatgcatggtaatcacttcgacttgatagatgatgattctcacaactacccgagaatgagaattgatccatacacttggaagaaactcattcaaaacgcaaccaatttaagagagcttaatttagatggcgtggacatgtcttgtatcggagagagctctttgtcattgctaaccaatctctcttcctctttgatctcccttagtcttgcagccaccaaattgcaagggaatctatccagtgacatcctctctttacccaatcttcaaaaactatatctggatcataataaagacctcggaggtgaacttccaaagtcaaactggagtactccactaagagacttggatctctctcatactgctttctcgggaaacatccccggttccattggccatttgaagtctcttggcacactatatctggggggttgcaattttgatggactgcttccctcatctgtctttaatctaactcaactctacactttagatctatcatttaataaattaattggccccattccatattggtgttattctttgccttccttgtcattcttggatgttagcaacaaccacctcacggtcaattgacttgagtggtcatctggactttcatcaattttcaatgttcaataatctagagcacctcaatttttctcacaatagttttctctctattcactttcaaagtaccgcattcaaaaatctaaatcacctcgatctttctcacaatagttttctctctattcaatttcatagtactgcattcaaaaatctaaatcacctcgatctttctcacaatagttttccctctattcactttcatagtaccgcattcaaaaatctaaatcacctcgatctttctcacaatagttttctctctattcactttcatagtaccgctgattcaaagttcaaaaatctaaattacctcgatctttctcacaatagttttctctctattaactttgatagtaccgctgactacatcttacccaaccttcaattcgtatatttatcttcctgtaatattaatagtttccctaaattcttagcaccacttcaaaatctggtcgcactagatctttctcataacaacattcgtggaagcattcccccgtggtttcatgagaagctcttgcattcctggaataacatttggcatattgatctcagtttcaacaagttgcaaggagatctcccaattccacccaatgccattcagagctttttagtctcaaataatgagctgactgggaacattccttcagcaatgtgcaatgcaagctacctcaagatactcaacttggctcataacaacttgacaggccagattctgccatgcctgggaacattgccttctcttttggcattggatttgcaaaagaacaacctttacggcaacatacctgggaacttttcttattacggaaatgaattggagactataaagttgaatggcaaccaattggatggaccattaccacggtctttgatcttctgcacaaatctggaagttttggacctgggagccaataacatagaggatacatttccccattggctagaaagcctccagcagttacaggtactcagtttgcgatcaaataagtttcatggtgtcatcacttgtttcggtgccaagcatccatttcccaggctgagaatttttgatgtctcaaataacaattttagtgggcccttgccagcgtcatgcatcaagaactttcaaggaatggtgcgtgtgaatgatattgatagccagagtggttcgaaatatatgggtaacgacaatttctataatgattcagtagtggttgtaatgaaaggtcaagaggtggagctcaagacgatattaaaaattttcacaaccattgatttatcaaataatatgtttgaaggagaacttccgaaagtcattggagaattgcattctctcatagggcttaacctttcgcacaatgcaatcactggtaacattccacgatcctttggtaatttaagaaatttggaatggttggacctttcatggaaccagttaacaggagagattcctgtggcttttaccaatttgaattttctggcaatgttgaaactttcacaaaaccaccttgagggaatcatacctacaggtggacaatttaacacatttgaaaatgattcctatgttggaaatccaatgctatgtggatcccctttgtcaaaatcctgcaatgaggatgaagaaaggccaccacattcaacatttcaccatgaagaatcaggatttggctggaaagctgtagcagtgggatatgcatttggttttctatttggaatgcttttgggatataatgttttcatgactgggaaaccacaatggctagcgagacttgttgaaggtgtgcttaattaattaagagtgaaaaggacaaatcataggggaagaaaatagtttactcttagtttattatggttcttttgtgtgtctgtatgttttctgtaattttaacttctgtcatgtggaagaaatatcgtctctggtgagtgatctatttcaagttgtttccaaataagaaaaaaaatgtgatgagtgctttggtttcaatgtcaagcaattaattttccgtaaattgacattatattaggaatatatatacagttctctggaagaattctggctaacccaattaaatgtacaattgtatcattgtattttcagatatagttagttcatgatgaatgctgttcagcatcaaagctactgtgaaaagaagtagaaaaccaacctttcggtagttttagaattcactgccgatgaaggttctgtgggtcttctgtctttttctttactaacagcactacagaaaagtccattagtttaagatcggtatgtttttgcttagtgaaaggactttatgccaaaactccaaccagaaagagtaggatttcttatttgccaaaacacaaggctatccttgaaacaaagtatttaatagtaaaagacggagaatttgcatacaaatggattgtcgcttgagttaaaaccttctttcaactctctgttctacaaacagatattgaagttgataattgagcctgatacagcctctggaaaaactgatccatatgcattacaaaatttctagacaaaggcatcagagggtaagcatgttcttgaaattaagggtagaggtaacattagaatcagataatgtacctcaattgttttttaaaataaaaataaataaacaaacataatatcagagaaaaatgttagtgatcagaggatgagagggatacatatcacaggcataagccaagtaatggaacaaatctcaagaggttgcacattgattgataaaaatacagagaaggtatacggtgctctttttatactatctattaagcgattaacatgtaattaaccatgatgaattaagtgattaactaactctaagtgaattttactagtctcctaataacacacgtgggagacgataatcttttcattcctagcgagaagatatcaaaatgagtgatcatcccatattattggctcaaagactttgatgcttatctccaaagataaaaacttaaaagtggacttttaaattaaaaattggtttcacctacccctgttattacatactttctccaaagaaaaatccctaaccaactcagtccaattatttattaattttgccgaatgatgatggtagatgtgcccaggccactgtgtccctttgggaggttccttaagcgaaaataaataaaccaaagtcaccataacaatgtgttaggaaaaaatataggaaacctattaaaaattcatatcaaaagataaaataaataaaaagtaatactaacaatataatcttgtttaacatttttttatcattgactaaatttgatgtgaattctattacaaaatttgagtaatgggatttactgtaaattaaaacatctcaaactgtcatttttctttatctgtatttgtatgtttaaacatcttaatagtgtgtctcttttcatctaccatcttttatcactattttaaatttgaatttcaatagttcttacaaaaataaattatcaatagttaaaaataatattatatcataatttaaattattcattataaatttaaaatataatttatatattaaaagtattgctgacacactttttattagctgaattttaaaattatttatttatgatggattttaatgatataaaaataaatttaatatgattctttcgtgcgatgcgtcttgttttctgaaattttaacttttgtcttttgtggaagaaatctcacctctcctgactgatctattttatttcaaataatcaaattgtttgcaaatacgaagaaaaaaaattgtgaagaatgcttttgttttaatttcaagtaactaattttccgtaaattatctagggtaacctgcataagcatcaaggagaatttgcacattgaaccttcaatcgacacacaattggcattatattaggaacatatgtacagttttctggaagaattaggctaacagaattaaatgtacaattgtatcattgtattttcagatgtaattagttcatgatgaatgttgttcaggaatcaaagctactgagaaaagaaaaaaagaaaattgaaaatgaaagtaacataagaataaaaataattttaatttttaatacaagctggtaattagctccttaaggttactttctagcatcattccaaagtcttccttttcttttggttgcatcttatttctctgcttcatagtctcgtgggttgctatttggaatgctcttgggctgtaatttattatttttgaaaatccaatcgatgaacacccctatccttcatgatgtcaaatttacacgacctaaaactctcaaatatacaagtttcataaacaaaagtttcagaacattttgggggtagcagataattgtaaagccatatgctaggcctatgcagtaaaaaaaaaaaaaaaaaattaaagaaatagggtgctaccgcactgcaacactgttgggtatgctttggaaataatttctttattagaatcacacagcacaaaatggttttggtatcgacattaaactatgcatttacaatattaaataagaacttgaaaaaaaaataacaaatgtacaactttactaaagaaaatgtaattattaatatattattactaaaacacatggaaggaacaaagtagaaaaccctacatcacatatattgatccaaaatcctaactctctccatggctgtgaaaattcaaactagtttttgtttacctacattctccattccaacttcaaaaccctacttaaactcgttcaccgtctcagcctccaaatccagctctggccgtaagctccgggcgacagtgattgatggtggcctcgctggatcctccgcagcagaggccctagcctccgacggcgtcgagaccttcctcttcaaacccaacccagcatccgtcgtgaagccatgcggcgcgccatccctctctgcatgctcgaagagtttgacattcctcaccacctcatcgaccgccacgtgatgttcatgcgaatcttctccccttccaacatcatcgttgacttcttcaaaaccctaaaaccccacaagttcatggccatgctccgctgcgaggtccttgaatccttcctccgctcccacgcacatgctgcaaagggtttttttttacgtagtaacgtgtccaggaacgctctggtggaactgtgtggggatgagtatgtccaacgcatgatgtttgagaactatttgtataagaagttggcacgttggagagtgttggatgatgctaagcttttcttcaataccattggaagcttggtgagatctaaagtgttggaaacgccacgcatggagagtttgatactatgactttggaaatcccactaagtgcatgcagcttctgcgtcattttgacgtggttttgttgcttgaatgttgatccaaaacgtgtttccaaacatgttttaaataatttgtttctgtaatttctgtgtactgtattattatgtaagcttctaacagaggcacttttgaatttgaagcaatgatggattgatcaccaattcaacaacacttctttaagaattgttttattcaaatacaaaagagcagtatacaatatttcatttgttgctgtcataattcaaaggcttaaataaagcaacaataaaacttatacaagaatgagctcatctgtccgtccaatcacacatcgaagacactgtccttcaatcaataaatcaaaggctttgttgatatccttgaactccacctcgtgtgtgacaaacccatccaaattcagttcctgttgataattgcagatgaaatttagtaccaaacaaatgcatcatgaaaacttggaaattgttattattattttacatagtcatcactatgttaatagaagggatcaagagcatagacacactaatgctaatgtgacgaatagctcacatgtatcagcattgtatgtgttaggggatttctcggttgattgtggagacaacactctgttctaccctctgcttcatggtcgtctctctttgtatccatgtaacggctccgatgccacccttcttcctcaactatttggtacttttctttatctttttcttcatcatttggactctgcattcgtgattcaagcaaattggacagaaccacttaaatctcacatgcaggatgcaggaagttataatttggaaccattgcattcgtgtcaggataaaataaatcttctttcagtgattcttgtaagtcctatcatggtgaatgaaagcatatttcctttcatttttttctgcataatgtgatctgaattaatgtattacgatagctgcccatttatttgagcaatttatcccataatcatgatctatagtctcgcttaagtgacatcaacgaaacaatggaatgatggagattatcaacgaaacaagggtttatggtgtgcttttcctcccttgataacttcaaattgaaaatttaactatgctatatgttgagtttcatcaagcatttgaaatctctttgggctgtcagaatctacaaaaccaatctgttcctttatattgtaagaaatttacaaacactcatgtgaaacaactgtatcaagtgttctttatacaggttttgaagacatgaagagtgcatgttgtggacttggtttcaatggtgccatgatagggtgtctccatggacatggtctgtgatcaagcttcaactcatgtttggtgggatttgttcaaccctactcaagcggtcaacaaaatttagactttgcaaatgaaaattatacaaaattgtatgattaatgaaaatattcctccgtgaatattttaataaaattttgtttcttataaaatttgttcatgaaaatattcaaggaacaaattatttttttttgaaactagtttaatttaaaacagaatgaggcgggatcagtgttcagttgcaacgaagaagaattctgtcacttgtatttggccctatgtgttgttgcatgtattggcatgtcccatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcattatcatcattattatcattattatcatcattatcatcatcattattattatcattattattattattattattattattattatcatcattatcatcattattattattatcatcattatcattattatcattatcattatcattatcattatcatcatcattattattatcattatcattatcattatcattatcattattattataataaccttggctttatacataaagaaaaaggaaaaagaagtttaaattttctatttttcggtcgcaaaagatatagcgacggctggagtgccacgcctggggcgtgggatccacgcctggagcgtgggaagtgctccagaaagtggatttcctctggaatgccacgcctggggcgtgggagccacgcctggagcgtgggagctcgggcagggccattatttaaagcccaaaacgcgaaaattgaaagagaaagacttcttcttcttccttggacgtcccagcagccattgttgagcttccaagcttcaatcttgctccatagttcaccaaattaagccccttaaacatcaatcttgatggaaaacacctagtgagcttaaatctcccatccattttccttgaaaaaccccaaatttgagaatccctttctcaagggaagttcttgaaacttgagttcggcgaggaacggcgacgatttgtgagtacccaagctaggggaagttgtttttgggccatccttgtcgttattgaggtaagaaactcaagtttcaccgattaatttgttgattggggttttgggtgaatagtgacccacttgagatagagctagaattagccttgggtcctttagagagatgtgtttagaacgtgttggggatgaaagattagctctcaattgttagtttggtgaactttggattgttggctctatgtaaagcatgtgttgttgattgagctgaattggttagtttaattgacatgttagagccatagtatgtgttttgttgtgccttggaggccatgaaaacggtgccattgtgtgtggtgtgaaccgttcaagcccggtgtgaattctgtggaattgggctattgtggtgagctttgagctctgtgtgctttggctaggccaagctagacctgtgagggtctgagaatcacttgtgaagtgattgagtgtgtactacacactgtggattatgcttcttgttgttctcacggcttaagaccgttgttgaagcattatatgtttgatgtgatgtaggacgtgagaccgagagtttcggtggtggtgatagtgaagccgggagagccggtgctttgctcagagcaggtaagctcttgatccttgattgtatgccctttgttgtgttctaccatgcaccatatttgggtgatggttctgttatgggcatttgcatgtatatagaaattgtatgttgacatgcttgactgatgcatggtgaatctgaaaccgtgatgggaattgttattgagatgattatgttgatgtgattgaatgataaattatgatctgaaacccgtgatgggaattggtatgaaaatgatattgatctgagattgctgagatgtgcttggacccagtgattgggtaattgctatgaatggttgactgatattgtgttcgctaaattgcgagaatgaaatgtgaattctatgattgaattgtgcatcctatggtagtaggatagatgacgagagattgagtaagacctgatgtgagatgttcctgtgatatagatgtagcctcccgaatggagatgttcctatatctacagatgtagcctcctcaggcaattgattgatgtaggatgtgagatgttcctgtggtatagatgtagcctcctgaatggagatgttcctatacacagatgtagcctcactagacggagatgtgcctgttacatagatgtagcctcttaagtgagatgttcctatgtttcagatgaagcctccaagagatatgttgtggtccgggcaagagatgttcctagtatatagatgtagcctccgtgagtggagatgttcctatatacctagatgtagcctctgccggatgatgtgctgtgtaccacctgtttgtagacaggatggggtgataccatagaagtggtatgtgtgaaggggatgagaccctgtgtgacttgatgatgaatgagaaatgttatgtgattgatgtaatgtactatttctatgtatgtgcctgaaagtgaaccaggggaaggaaataccttcaagggccctgagtttactgagattttatatctcaccccttgtgtggggcttatgttttgcaggtgagtcatcagcaggagcagagagatcccaaggcaagaagcctatgcagggatagttgctgattgaaaaccttaggcttagatgacatgagcatgtggctctggtattttgagtagcctttggttttgatttttgttgtaccctgaagggatattgtgtacaattttgtacttaaacagtgaatttgtatatgaacaccatattataatgtacaatgtgtatgttatcggcatttgttgatgcccttttatataatgcttccaaactgcttaatctctgatgtattatgtctgataatgactgtttatccgtggtaatcacccggtgcgtgtaaggggtgatacaattatcattatcattatcattatcattattattatcatcatcattatcattattattatcattattattattattattattattattggaagggtctttactatttgcttaatttttctaacagtcttagacatctcctctgaccattctggaggattttttctaagtctctcatataacaaggcacactcaatcctaatttttggaataaaatcagctatataatttatgcaacctaaaaacctttgtaattgttttttatctttaatctcatctggaaatttttctgtaaattctatggatctctgtattggtataatggaccacaaatgcagttttatatttatcttcctctctcaccgaaatttgatagtagtctgatttcatgtcaaatttggaaaaaatagatgcattaaataaccttttaatcaaatctggtttatttggtaaagggtatcttatccattttaaaactttatttaagggtttataattaattactaacctaggagttcctcgttctatttcagaagccttcataacataaaatcctgaacaactccacggtgatttagacggtcttattaatcctttttctaaatattcattaatttcctttttacaatgttctaaatattgttggttcatttgtatgggcctagctttagtaggtatatctttttcattaaaattatctatataaggcaatcctatttcatatttcttcctatgccaaaaagctattggattattttcgcatatttcttttttaattttcttttcaattttttccttcttttctttaactatagtgttttgtaattgttcttctattcttttataatggagttccttatttaacatattaatctgtttcattttatttttaattattttgactgacgaattttttattatatttaattctctttctctagggggattaataaattcaaaaacaacttctttacctataacttatgtttttattcctttttctgttacttggaaagggtataatagtgataaaaatggtgttcctagaattatttcacagttcatatttttnnnnnnnnnntctctttctctagggggattaataaattcaaaaacaacttctctacctataacttatgtttttattcctttttctgttacttggaaagggtataatagtgataaaaatggtgttcctagaattatttcacagttcatatttttaattaatacaaatgaagtattataacatattccatttttacaaattcttgcattagataatttatagttaattttcatttttgagccattagcactagatatattttctacggatttctcataatatttagtaggaattaaaccttcttgaatacaatttacatctgctccagaatctattaatgctacaaacttaaaagtttcttctttaattgttaaagttatttcacaatatatgccatttatgagtaataattaaacttaatagattaataaaattttcttctttttccgaattattagattttgaagtactggccatattggtttgttgttctctaattatattatttccttctaattctaaaattctatattccaagaagccagttagatattgaggcagataaagaagcattgtttttagcccaaaagagtcagataatggcagaactagctacggctacctctcaagaagaatttgaagagaagatccagagaatgaaggggatatctcaagactagaaatcgataaaagatgaaggaagcagttccagcaccaatccttatcacaaaaatagggatatgctggattacttcaccaaagaagaattatccgaataaagccaaaaccccaagagccaatcagaagtgtcggcaaggcaaataaagatagtgggataaaaagcagtctcaacaaccaataagaagtgtcggcagaagacagaggtactgctgacaagataaaaagatacctgtctatgtacataggagtgttttatataacgtgttttgtaaaagtcttactttttagggtcactgttgtaaatatttaagtaagtttggaatccggaccgtgtgttgtatctatatatagatgtaaataaaccagaaagaggcatcagccttttatcctaaccttactcttgtttctataacttcaacattccttctcttatcttccgtgcatcaatactcctgatcataatcgtactaacctaccttcaagaatatttaagtaagttttctaaatatgaattctgaaatctttattcctgttgatttctttcatgttttaaatatttataccagtttccaatattgtaatgatcatatacatatcagcgtaattattgaatatcaaaatatttacctaaggtttattaattattattattattattattattattattattattattattattattattattattattattacattccattcgtaatgaccaaaaggtaccgcaaaagcagttttttaatggtttataattaattactaacctaggagttcctcggtctatttctgaggccttcataacataaaatcctgaacaactccaaggtgactttgagggtcttattaatcctttgtctaaatattccttaatttctgttttacaatactctaaatattgttgattcatttggataggtctggctttagtaggaatatctttttcattaaaattatcaatatatggtaatcctatttcatatttcttcctatgccaaaaagctattggattggtttcacatattttttgtttaatttgcttttcaattctttctctttcttccttaattattttactctgcaattgttcttctattcttttatagtgaatttctctatttaacatatttatctgtcttgttttatttttaattatactaactgacgaattttttattatatttaattctctttctctaggtggatttataaattcaaaaataacctctcttcctattacctctgtttttannnnnnnnnncccaaaaacaaataactctaaaagatttacaagaagaaattaaaatacttaaacaggaaattagagaattaaaacaacatgatataactttagaatattaatttattctaaaaatattaatcaacatatagaacatttagaaatatttataaacattataaaggaaaatggattggtagtctcagaaaagaaaataaaattattcgaaactaaggtaagatttttaggatatgagatatatcaaggaaccattataccaatacagagatccataaaatttacagaaaaatttccagatgagattaaagataaaaaataattacaaaggtttttaggttgcataaattatataattgattttattccaaaaattaggattgagtgtgccttgttatatgagagacttagaaaaaatcctccagaatggtcagaggagatgtctaagactgttagaaaaattaagcaaatagtaaagacccttccctgtttaggaatacctgattcttcagcctttcttattgtagaaattgatgcgtcagaattaggatatggaggaatattaaaacaaagaatctctccactagctaaagagcaagtagtcagatatcattcgggtatctggcatccttcccagaaaaaatactctgttgtcaaaaaagaaatacgtactttctatagttttatgtttacaaaagttttaagatgatttatttaataaaatttttttaatacgaacagattgcaaagcagcacctttggttttacaaaaggatgttaaaaatttggtttctaaacatatttttgcaagatgtcaaagtttattatcttgttttgattttgagatagaacatataaagggagaaaagaattttttaccagattttttaacaagagaatttttacagggttcagaatgaacaagaaaccagataaaaagcctctaaccaaagatcaatacggatccccactggattccaataaaggttctgacaaagcaatagtgcctctggcaaatactggatcatccaggttattaactaaccctaacctaagaccaaatatattgtcccatgtagttagaagcccaacaccaaatacaaaccggtatacacctttgcaatatatcaataccctcgtgggaccaagagactttgataaaccagcctcttcaaaattaaccaatactcaaacattccaaaccaataccgatacagacccagactatattaaaaaggacgataccttgtccataataatagcagaaaaacattggctaaaactacctccagtagagttagcagaaaaaatattccctaaagacctcccatacccatgtccagataccaatgggtctcctataaaattttgaattattgtaaaaataagggttgctactgcatcttgttcttgggtttcctgttttatactatttaatattaaatttctatcttcttctaaacataaattatcccaccaacctttaagttggcctgtaaatccctgaactatggctactgctgtatttctatctgaaattcccttagtcttataagcggttgcaaccatattcatctgacaagttaaatctagtatttgttgttcactcatcccatctatattccattcagctatttctgatcctgaatatacattttgacgcatatctcccctttcctcaaattgtacatctgttggggaaggtctagaataataatttctaagtttaggataataatttgttcctctctttaatttattaatttctaaattattatttctttctaaagtattaattgaaactttttctatacttaatttttctaaatttcttcttatttcttcaattttatgatcagtattatttcctaatcttattgaatctaaatctttttgtgaaacgttcataattttatatataggtttatctatgttcttttttatttctttattttcagctttcttttcctcttgtgcattgttttctatcctagttaaatgagtcgaaatagtatttaacataatattagaataatttaattggtgatataattttctaatatcttttatttctattattttttcttctaatacttctttaaatggagatgcttctatttctaagtttgcgacattaatttttactcctttagctggcggatattccgattctattatcttatcatctgtagttttccataccgttgtattcttagttaatggattaatcactttttctttattaaacatccaatcaaagaaataaatattaatttcattttcttctaaatacttataatattcttgtctaattttatccctttcagtatcttcgtatgtactaaaaaaccattgtctattatccttattatattctgctaagaaatcttgtttaatccattctttatctattttaaatggttctatttctctagttaaaacatttaatacctgtgacctagttggagaatatcttggtgatgaattatcatcttgatatatgggtctagatacctttggattactattatctattcttgttaaatccaaatctatagttgttccacttatcgaatgtctagatgattgtcctttataaatcacataaggttcttttatatttaatgactgtgatctatttagtcttaatctaatatctgtaccatcttctataatttctctaatttgtgtattatgtattttgggtggttctaaaatatcctctattttccattcttcaggaatattttttaaaacttcttcatgtcgtaatctttttggaacttgtacctgagatttatgcaaattagcctctactaatattgtctcatctttattagatgctcttagtgctctaaaattataatttattttagttactttataatatattctaaaaattatctgtacgggatctgttactcctttaactatattttggggaacctgtatatgtaattttattgaggtacttgtatatttatttcttaaattcattgaaaaatttgggtaacaattaaaaaagcatgggccatcatgtaaattactctctaatatagctattactgaatctttgaattggaccaatcttgtatctcttaataacattaatattggtgtattaactcctaatcggtaattaggttttgtggccacttgtattaatcctagatgaataaaattaaatcctttatatatatgttcatttaatatgttttgttctaaaatatttattattttattctcttctgttcctgggtaactatattctacaatatgtatttcatctttgtttttatccgaggaaaatatgctatgttttttataaacttcacttttctttactaaaggtattgaccaattatgtaatgatttttctatatcttctactataactttatcattacttatcatatctatagattcttccatattggttaattgttgcggagttcttacaactatttgtttatctttatttccccttcctatttcactcagacttctaactatattagctattttacttcttgattgagttgctgttacgggaccacctctttccatttctaggctaaaccaacggacttacacacttacaactgctgggaccacctagacacaagaagctgaccaacgtatacacacctctcagtgttacactcaactcgatctggaaatagaataactcttatagatggaaatctttatggaatattaaggaaaaataaaaaaaaactttaaactgtataaaactctttaacaatattttgattttttagtggctctgataccactttcggaagctaaacttgatacaaaaatattaataaaccttaggtaaatattttgatattcaataattacgctgatatgtatatgatcattacaatattggaaactggtataaatatttaaaacatgaaagaaatcaacaggaataaagatttcagaattcatatttagaaaacttacttaaatattcttgaaggtaggttagtacgattatgatcaggagtattgatgcacggaagataagagaaggaatgttgaagttatagaaacaagagtaaggttaggataaaaggctgatgcctctttctggtttatttacatctatatatagatacaacacacggtccggattccaaacttacttaaatatttacaacagtgaccctaaaaagtaagacttttacaaaacacgttatataaaacactcctatgtacatagacaggtatctttttatcttgtcagcagtacctctgtcttttgccgacacttcttattggttgttgagactgctttttatcccactatctttatttgccttgccgacacttctgattggctcttggggttttggctttattcggataattcttctttggtgaagtaatccagcatatccctatttttgtgataaggattggtgctggaactgcttccttcatcttttatcgatttctggtcttgagatatccccttcattctctggatcttctcttcaaattcttcttgagaggtagccgtagctagttctgccattatctgactcttttggactaaaaacaatgcttctttatctgcctcaatatctaactggcttcttggaactttattatttcttgcccattgtaacattttctctttattaattaatttcacatcaaacttcttccaccactttatttttacttgtcttgaaagaaagtataaatctgtaacgttatctgccttgacgtatgtataagtccagcacattatccatgttattccttgggaggctatgaaagacaaaaacttataaccatctacaaaggttgtattatctttaaaaaatctgtataattcatctacttctggagggaacacttctctcattggtccaaagttaaaaaaccatttgatgaaccattttgggaattttaacgatataccttttttaaaccacagaaaccaggaatgtttatctggcttcatataacacattattccaggcggtcatgtagtcgtaataactgtattcttgagggacaaagcttctggaaaatctcttggttttatgtaatggctgtccccaatcaatatctgacaatacattcagaattttgagctttgaaaactgtataactccattattgtcttcgttatggacgagttctatagagtcggtatcaatgagaataaactcataaaatatcctggttttattggtatctggacatgggtatgggaggtctttagggaatattttttctgctaactctactggaggtagttttagccaatgtttttctgctattattatggacaaggtatcgtcctttttaatatagtctgggtctgtatcggtattggtttggaatgtttgagtattggttaattttgaagaggctggtttatcaaagtctcttggtcccacgagggtattgatatattgcaaaggtgtataccggtttgtatttggtgttgggcttctaactacatgggacaatatatttggtcttaggttagggttagttaataacctggatgatccagtatttgccagaggcactattgctttgtcagaacctttattggaatccagtggggatccgtattgatctttggttagaggctttttatctggtttcttgttcattctgaaccctgtaaaaattctcttgttaaaaaatctggtaaaaaattcttttctccctttatatgttctatctcatcaaaacaagataataaactttgccatcttgcaaaaatatgtttagaaaccaaatttttaacatccttttgtaaaatcgaaggtgctgctttgcaatctgttcgtattaaaatttttttattaaataaatcatcttgaaacttttgtaaacataaaactatagaaagtatttcttttttgacaacagagtattttttctgggaaggatgccagatacccgaatgatatctgactacttgctctttagtttgtggagagattctttgttttaatattcctccatatcctgataccactttcggaagctaaacttgatacaaaaatattaataaaccttaggtaaatattttgatattcacttggtgcattttttaatccaaagggcattacattccattcgtaatgaccaaaaggcaccacaaatgcagttttatatttatcttcctctctcaccgaaatttgatagtagcctgatttcatgtcaaatttggaaaaaatagatgcattaaataaccttttaatcaaatctggtttatttggtaaagggtatcttatccattttaaaactttatttaagggtttataattaattactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcctatttcatatttcttcctatgccaaaaagctattggattattttcgcatatttcttttttaattttcttttcaattttttccttcttttctttaactatagtgttttgtaattgttcttctattcttttataatggagttccttatttaacatattaatctgtttcattttatttttaattattttgactgacgaattttttattatatttaattctctttctctagggggattaataaattcaaaaacaacttctttacctataacttatgtttttattcctttttctgttacttggaaagggtataatagtgataaaaatggtgttcctagaattatttcacagttcatatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgttttaatattttaatttcttcctgtaaatcttttaaggttacttgtttttggggaagaaatctattataaatttctttcatatctactcccctaattggttctctattagtttggtcttttattattaattcattaagttgtcctatgaattcttctctgataggagaatcttctaattttcctattatacttatcaatgcttcagtctggtctctagttaatatattaatagttttacaatgcttacacgtacatatttctggacctaagcaataattatcttcttcttctgactcacttaacttactactgctagtatcttcttctaaatgatataacatattatcttcagatcctgattctgattctgtatcatcttcttcctcttgttctgaatttaacacgatttttagtaattcggttttaacatcttcgtctaattctaattcattaattttctgttgaactgtacatctattggcaaaatgtcctagctttccacacttccaacagacattttctttttattctgatttagttttttatgtttcttattataagagggtttataatttttattatagtctctaaaattatccctatattttttatgatatttctttttagagtatattttactacttctaatttttctctttttattctgtgtactgggggctcttattacctctattccatattgatgacaaaaagttcctaattcttttctatttgtcatgctttcctttctcatcttattctgaagtttaaaatctgtacaaacttgtattcctgtttctactattatattatgaatctgtccaaaagttaatttttcatatgagattggattttgaaaatgtctttctaagtttatccttacttttttgaaaataacttaggtaatcctgatataaatttttctttccagtatcctgcatatccatcttcccttaatgttattttggagaaaaatgtatctttataccatctataatctgacatagttggacaatataatttatttaattgactagcgattcgttctttaaatatattagggtctcctataaaattttgaattatagtaaaaataagggtggctaccgcatcttgttcctgtgtctcttgttttatactatttaatattaaatttctatcttcttctaaacataaattatcccaccaacctttaagttggcctgtaaatccttgaactattgctactgccgtatttctatctgaaatccccttagttttataagctgttgctgccatattcatttgacaagttaaatctaatatttgttgttcactcataccatctatattccattccgctatttctgatcctgaatatacattttgacgcatatctgccctttcctcgaattggacatctgcgggagaaggtctagaataataattcctaagtttaggataataatttgttcctcttcttaatttattaatttctaaattagtatctctttctaaagtgttaattgaaactttctctatacttaatttttctaaatttcttcttatttcttcaattttatgatcattattgtttcctaatcttattgaatctaagtctttttgtgacacgttcataattttatatataggtttatctatactcttttttagttctttgttttccattctcttttcttcttgcggattattttctatcctagttaaatgattagaaatagtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatataaggttcattgatgtttaatgactgtgatctatttagtcttaatctaatatctgtaccttcttctataatttctctaatctgtgtattatgtattttatgtggttctaaaatatcttctattttccattcttcaggaatatttttaaaaacttcttcatgtcgtaatctttttggaacttgtacctgagatttatgtaagttagcttctactaatattgtctcatctttattagatgctcttagtgctctaaaattataatttattttagttactttataatatatcctaaatattatctgtacgggatctgttacacttttaactatattctgaggaacctgtatgtgcaattttattgaagtacttgtatacttatttcttaaattcattgaaaagtttgggtaacagttaaaaaagcatggaccatcatgtaaattactctctaatatagcgattactgaatctttgaattggaccaatcttgtatctcgtaataacattaatattggtgtattaactcctaatcgataattaggttttgcggctacttgtattaatcctagatgaataaaattaaatcctttatttatatgttcatctaatatattttgttctaaaatgtttattattttattttcttctgttcctggataactatattctacgatatgtatttcatctttatttttatctgatgaaaatatactatgttttttataaacttcactctttcttattaacggaattgaccaattatgtaatgatttttctatatcttctactataatcttatcattacctactatatccattgattcttctatattagttgattgttgtggagttcttacagctatttgtttatctttatctccccttcctatttcactcagacttctaactatattggctattttatttctagattgagtcgctgttacgggaccacctctttccatttctaggctaaaccaacggacttacacccacttacaactgccgggaccacctagacacaagaagctgaccaacgtatacacagctttcagtgttacactcaactctttcttgaaataaaataaatcttatagtttgaaatctttataaaatattaaggaaaattaagataaagtgctagctgtaaaatttttttaacaatgttttgatcttttagtggctctgataccacttctgggaacttggtatgaagatgttaacaaaacttatataggtactttgaaattcaataattacactaatatgaatatgatcattacaatattgaaaacttgtataaatatttaaaacatgaaagaaatcaataggaataaatatttcagaattcatctttagaaaacttacttaaatattcttgaaggtaggttagaagggatatgaccaggagtattgaagcacggaagataagggaagaaatgttgaagatatagagaaagtgtgaagttaggataaaaggctgatgcctcttctggtttatttacatctatttatagatacaacacactgcccggatgtattcctccggatttcaaacttacttaataatattcaataatgacctaaaagtaaaactattacaaagcacgctacataagacactcctatgttcatagacagatatctttttatcttgtcagcagtacttctgtctcctgccgacacttcttattggttgttgagaaagctggttattctgatatctttatttgccttgccgacacttctgattggctcttgatagttttgtctttattcggaaaattcctctttggtgaagtaatccagcatatccctgttcttgtgataaggattggtactggaactgctaccttcatccttgattgatttctggtcttgagatattcctttcattctctgtattttctcttcaaattcttcttgggaagttgccgtagctaattcggccatgatttgacttttttgtgctaaaaataatgcttccttatctgcctcaatatctaactggcttcttggaactttattgtttcttgcccattgtaacattttctctttgttaattaatcttacatcaaacttcttccaccactttatttttacttgtcttgaaagaaagtataagtctgtaacattatcggccttgacgtaggtataggtccagctcattatccatgttatcccttgggaggctatgaaggataaaaatttataaccatctacaaaggttgtattatctttaaaaaatctgtataattcatctacttctggagggaacacttctctcattggtccaaagttaaaaaaccatttgatgaaccattttgggaattttaacgatattccttttttaaaccaaagaaaccaggaatgtttgtctggcttcatgtataacacattattccaagcggtcatgtagtcgtaataattgtattcttgagggacaaagcttctggaaaatctcttgggtttatgtagtggctgtccccaatcaatgtctgacaatacattcattactttgagttttgaaaactgtatcactccattgttatcttcgttatggacgagctctatggagtcggtatcaatgagaataaactcataaaatattctgattttattggtatctggacatgggtatgggatgtctttagggaatattttttctgctaaatctactggaggtagttttagccaatgtttctcgtctattattatggacaaagtattttcttttttaatgtagtctgggtcagtatctgtattagtttgaaaggtttgagtattaactaatttggagaaggctggtttatcagtctcttggtcctacaagggtatttatatattgtaaaggtgtatacctgtttgtatttggtgttgggcttctaactacatgggacaatatatttggtctgaggttagggtttgttaataacctggatgatccagtatttgccagaggcactattgctttgtcggagcctttattcgaatccagtggggatccgtattgatcttttgtgaggggctttttatctggtcttttgctcattctgaaccctgtaaaaattctcttgttaaaaaatctggtaaaaaattcttttctccctttatatgttctatttcaaaatcaaaacaagatagtaaactttgccatcttgcaaaaatatgtttggaaaccaaatttttaacatctttttgtaaaatagaaggtgctgctttgcaatctgtttgtattaaaaactttttattaaataaatcatcttgaaacttttgtaagcataaaactatagaaagtatttcttttttaacaacataatattttttctgggaaggatgccaaatacccgaatgatatctgactacctgctctttagactgagaagaaacttgttgttttaatattcctccataacctaattctgatgcatcagtctctacaatcagaaaagctgaaggatttggtattcctaaacagggaagggtcttaaccatctgtttaatcttcctaacagttttagtcatgtcctctgaccagtctgaaggattctttctaagtctctcatataataaagcacactcaattctaatattaggaataaaactatataatttatacaacctaggaatctttgtaattgttttttatctttaatctcatctggaaatttttctgtaaagtctatagatctttgtatgggtataatagttccttgatatatctcataacctaaaaatcttatctttgtttcaaataattttagtttcttttctgacactactaatccgttttcttttacaattttaataaatatctctaagtgttctatatgttgattaatatttcttgaataaactaatacatcatctaaatatactatagtaaaatgggaatatttataaaatatgtcattcatgatattttgatattcacttggtgcattctttaatccaaatggcattacattccattcgtaatgaccaaaaggcaccacaaaagcagttttatatttatcttcctctctcaccgaaatttataaatcatataaggtttattattattattattattattattattattattattattattattattatcatcatcatcatcatcatcgttatcatcatcatcatcatcgttattatcatcatcattatcatcgttattatcatcatcatcatcatcatcattatcgttattattatcatcatcatcatcatcattatcgttatcgttatcattattgttatcattgtcattattgttatcattgtcattattgttatcattattgttatcattattattattattattattgttattgttattattgttattattattattattattattattattattattattattataatatactactactactagctactacttcacaaccattgatttatcaaataatatgtttgaaggagaacttccgaaagtcattggagaattgcattctctcaaagggcttaacctttcgcacaatgcaatcactggtaccattccacgatccttttgttatttaagaaatttggaatggttggacctctcgtggaatcagttgaaaggagagattcctatggctttgatcaatttgaattttctggctgtgttgaacctttcacaaaaccactttgagggaatcatacctacaggtggacaatttaacacatttggaaatgattcctatgctgcaaatccaatgctatgtggattccttttgtcaaaatcctgcaataaggatgaagattggccaccacattcaacatttcaccatgaagaatcaggatttaatttggctggaaagctgtagcagtgggatatgcatgtgggttgctatttggaatgcttttgggatataatgttttaatgactgggaaaccacaatggctagcgagacttgttgaaggtgtgcttatttgaggagtgaaaagaacaaataacagaatccatgcaaattgacaaggaatgcattagtttactatggttctgtattatatgtgtttatcagtatgtatgtatgtatttttttttttataattttatcttctttgtttgtgtaatgaaatttcgtctctcaatattatcaagtgatctatttcaagtttttgtgcaaacaactaaatttagagatcaatcaattttgttttaagttcaatttatttgctataaattgtgtaattagtcgtatcctgcaaaggcattgaggaaagtttacgcgtccaaccttaaatcatcacaaaaatcagcattttattaggaacaatgttggacagttttcttgaagaacttggattttcccaattgaacatacaagagaatcagtgtatattagattttccaaacaagctagatttgtgttttattgtttactagaagccatactaattaccgcagtggatataaaatgaagcaggaattcaacatgctacactttcaactgagactattttaacaggatttttttttctattgaaatcgattaagatttttgaccaactttaatcgagaccatttttgctggcatcaatggcccaagccggaattagcgaaaagatagtcttgatcgacgtccctccaaaatagctttagttgatgtgaccaaaaaataatatcgactaacattgatcagaaaatatcctagctgacgtagctcaggccgatatcgacaaataccatgatccgtcagtgtcagtcaaaaaaacataattggctaatgtggactgaaaaatctaactaacatcaaccaaaaaatagtcaaaaccaatgttgaccgaaaaaatcctaacctatgtcaacaaaaaataaccctatctcacctcgacaaaaaaaattaccgaccgacattgactgaataacctagctaaccttgaccaaaaaatattttcacatcgattgacatcggcaaaaaaccctaatagaaattgatatcggtcaaataataaatattcctttttgggtggtatacgagaagctgctcaatcgattagttattaaataccattaattctatgtgtgttatggatatctctacgtgcgattcattgagatagaaattttttgatactatttgctatacccctctctttatagtactttgtattaaagtaggaaaataaatggaatatatatctatttaatttttttatttattttttgcattcggattgaaatttaatgagatagtaatatgagtgcaataaaacaacttcttttgaatataatttatagaatactatattaattatagttaatagaaaagatgatgattatagaataatatattaattatagctgcccatttatttgagcaatttattccataatcatgatctattgtctcgtttaagtgacatcaggcacacacatgcatcatctctttctgtaagttcttcactggtaaattagaggggtaccaaaattatctgttatttctgcagaaacttttcaatattgacttacgatgagcataactaatgttagcacgggctcacacagatttaacactaattgatgtaatgggattattgtgttgcagctgagaagattggattgacatcaatccggccattttatggacaaaatggatctctggaggaggttcttggtggcctcaacgtgggttcaacacaagctataatcatgaaccagggaagctacagccaccagtctcttaaccaacaacgacgccgaatttctgagactatccagctgttgcaactgcagctgaacgaggacactgctctccaatttacaaaatcctccgtcttttttctctccttcggcaaagaagattacattgagctattccttcataactcttccagttcgagtcgaatgttccagaacagttcccaatattttgctaccattttggtcaaccaaatggcaaatgctgcgaggtatctttataatgcaaatgccaggaaaatcatatgtttgagaattctgccttttgggatgcacacctcgtatggcctgggagttacacatcagctggagattatcatgcaagtggatgtgtcgaacatgtcaatgacttggtctttgaatacaatagattgctggatgaacaaatagggaagcttaatacggaattttctgatgctcagatggtgttctgtgatgtttacaatggaatgatggagattatcaacgaaccaagggtttatggtatgtttttcctcccttgataacttcaaattgaaaatttacctatgctgaatgttgattgtcatgaagcatttgaaatctctttggcctggcagaatctacaacagcaatctgttcctttatattgtaagaaatttacaagcactcatgtgaaacaactatatcaagtgttctttatacaggttctgaagacatgaagagtgcatgttgcagacttggtttgaatggtgccatgatagggtgcgtctccatggacatggcctgggatcaagcttcaactcatgtttggtgggatttgttcaaccctactcaagcagtcaacaaaatcctagctgatgcagcctggtctggccaaccgatacctgatctttgccgtcctatcaccatccatgggttggttaacatggaagtctagcatttcctgtggctaccttcaatccttcatgatatcaaatttacactacttaaaactctcaaatatacaagtttcataaacaaaagtttcagaacaatttggggtaagcatataattgaaaagccatatgccagtcccatgcagtacagaaagaggtaaagaaatagggtgctactgcactgtatcactgctaggtatgctttgaaaatcatttcttcattaaaatcgcacagcacaaaatgggttttggtgctgacagcatttgcttttgtcctctgaaatcgattaaaactatgcatttacaatattaaataagaacttgaaaaagataccaaatgtacaactttactgaagaaaatgtaaaatattattactaaaacacatggagggaacaaagtagcaaaccctaaatcacagatattgatccaaaatcctaactcactctccatggctgcgaaagttcgaactagtttttgtttacctacattctccatcccaacttcaaaacccaaaaaaccctacttaaactcgttcaccgtctcagcctccaaatccatctccgaccaaatgctccacgcggcagtgatcggtggcgtcccagcctgatcctcctcggcggagaccctatcatccggcgggtcgagaccttcctcttcgaacgcaaccgccgtccgtcgcgaagcggtgaggtggtgccatccctctctgcatgctcgaagagttcgacatccctcgccacatcatcgaccgccacgtgacacgcatgcacatcttctccccttccaacatcgccgtctactttggcaaaaccctaaaaccccacgagttcatcgccatgctctgccgcgaggtcctcaattccttcctccgctcccgcgagcacgtcgccggcgctatcgaggtttccggcctcgacctccccgcagcgccggacgaccctacaccgtccactacaccgccaactgctcctggcgccactccctatccgtcaacgtcgtgatcggcgccgatggctccaatagccgcatggccaaagccatcggcaccggcgactatgccgcgccatcatgttccaggagtatttttatatttttatcccttttaaatacaaatatttaaaactaattaattctaattaagatttgatttaacttttgattttaaatcataaactatataaaacaaagatgttttttttttttataaactatatttaaaaattatggtaatctttgttcatctcaattaatttttgaaatttaacatactattttaataaaaaggacgtgtcttgattcaaataatttatttatctcttcaatttactatttaataaaattgattagttattattaataacgataacatttattatttttatttatatataatataagtatgtattttttgcaaccattttttcttctttaagatcatatatgagtacaaaaaaataatgacaacatcatacatgagtacacaaaattaatgataacagtgaaataaatagattaaattggcaaactcatttctcaaagttaaagaaaatgtctgtcttttcaaacatttaaaagagtggaaatacttcaaattccaaacaaaattttattaatcattctaattaaaggttaacatgatctgtaaaaatttaattaacctcaacaaaagggatttagttaatataaagaaaattgaataggaaaaaaagaattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatattcctccgtgagtatttgattgaattttaatcacaaaaaatatttatttattttaataaagtttcatttcttataacatttattcatgaaaatatttaatgaacaaattatttttgaaactaatttaatttaaaatagaattaaccataagaaaactaaaaacaaagtttatgtggaaaatgacttaatatatttttggaaataattcaatttcaaaggaaagatatcataatgcaaatatatatgaaattaaattttgaaataatttaatttaaaattaatcaaatattgaagtatcaattcaaataattaacattactatattttattttttccttccattccaatcacaatcaaaactaaatgacattttttaataacattttttactgttaaaacatttttagatgatgtttgaaacttaaaaatataaattaaatacaaaagaattctattgcaattaaaaattttcactcagttttttgttatccaagatcatgagtgcaaatcataaaaaaattaaatcaatttttttaaaaaaagatcaaaagaaaatatgtaagacatcatcaaaataaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaacaaattttttgaaaaagaaaactagtgtgataaccaataaaattttgaagaaataaatttaaatatttctctttgtaaaagtaaaaaaaaaaaagaagacaattttagtaaccttttaattatttgttatagttatgtttaataatcaatttacaactcttagtgtaattaatctgtttttgtattataattcgagttcttttattaaatgagagtgtttttaggcatggttatttttgagtaaatgattcaaatcctaagattatggagaaaattatgaaattgtgaatccatggaataaacatattctcttcaagactaaataaaattatcatattttttaggaaaaagggtttggtttcaggaacacaatcacatgaatacgaatacaacaacaatgactgttttagaccaacaacctccattgactcactctcgttaaacaacctttacgaggagtgcattgaggaagttgtccctccaatgttcaaagcaaaaacaattaaagaatgaattttgggtttcactaatgcgataacaaagggacgaatgcagctacaacgatgaaggcagatcaatcacctttatgaaaataacaaaatcactttccctatggactatggtgtgaaggagaaggggtgattttgtgcagtagccacaataattgggtcttcttttttcctattccctaatttcattcttttttatttgatttaaaaaatttcttctggtttttactttttattttgttaaaattgtttaataataaaataatatttttttaatccatgtcatggttatttgatggggatcacccactatagagtgatttgcttaacattttccttaaccaaaaacactataaatgaagtaaaaaaatataacatctagaggaaactataattaattttaacattgttacaataatcaattagtagcaaaattataaatatttaaactttttaatggttggcaatataaaaaaatatctaaataacagaaaattattctgataatgatttagaaatatattattatattaatatcaactgagtaaaattaaacaaaagtgaaaatatttcttaattgaataaaaataaaataatagatataataaatgatttgataaaaagagaaaaaataaataaaggtaaaaataatgagataaaggaaaaattatgtgcgcctttataatggtagacatgatatgatatgaaacacaggcgaaggaataaaaagcaaagaaagagttgaagcgtaggctataaatagaagtttgtgaattgaattggttctatccaaaaatcctgtctagttttgttgttgagttgaaacgatgaatatgaataacaatgttcggtggcttctactcccatactttatcttccttcttcttctttttcttccttcttcttcttcttcttcttcatctttctgcaaccaccatgacagctctgccttgctacaactcaaatactcattggctctcaacactacacatgattattattggtggcttgatgattattcctctttttcttcaaagacagaatcttggaacaacggaacagattgttgtgagtgggatggggtcacgtgcgacatcatctcaggccacgtgattggtcttgaccttagcttcagtaatcttgaaggtcaactccatcccaacagcaccatcttcagcctaagacaccttcaacgactcaacctagcctttaatcagttttctggctcttcaatatattctgaatttggtgatctggtgaatctcatgcatctaaatttgtcatactctggattcactgctcacattccctccacaatctctcacttgtccaaattactgtcacttgatctcggtagttatagaactgctgaagatccgagaatgagaattgatccatacacatggaagaagctcattcaaaacgcaaccaatttaagagagcttaatttagatggcgtggacatgtcttgtatcggagagagctctttgtcattgctaaccaatctctcttcctctttgatctcccttagtcttgcagccaccaaattgcaagggaatctatccagtgacatcctctctttacccaatcttcaaaaactatatttgtttaataatgaagacctcggaggtgaacttccaaagtcaaactggagtactccactaagagacttggatctctctcatactgctttctcgggaaacatccccggttccattggccatttgaagtctcttggcacactagatctggggggttgcaattttgatggactgcttccctcatcactgtttaatctaactcaactctccactttaagtttaagcgcgaataaattagagggaccaattccaagccaaatcaataaacttcaaaaattgcagttgctatttttgtcttataacaagttaaatggaacaattccgcgttggtgttattctctgccttccttgttagtgttgggtcttagagacaaccacctcacggggtcaattggtgaattctcatcttattctttggaatacttgtcactctctaataacaaactgcaaggtaatttaagtggtcatctggactttaattatttttcaaagttaaaaaatctaaattggctcggtctttctaacaatagttttctctctattaactttgatagtaccgctgactacatcttacccgaccttgaacgcttacatttatcttcctgtaatattaatagtttccctaaattcttagcaccacttcaaaatctgctcgcactagatctttctcataacaacattcgtggaagcattccccagtggtttcatgagaagctcttgcactcctggaataacattagtcatattgatctcagtttcaacaagttgcaaggagatctcccaattccacccaattatattcaatactttttagcctcaaataatgagctgaccgggaacattccttcagcaatgtgcaatgcaagctccctctatatactcaacttggctcataacaacttgacaggccagattcctcaatgccttggaacatttccttctctttcggcattggatttgcaaaagaacaacctttacggcagcatacctgggaatttttctaagggaaatgcattggagactataaagttgaatggcaaccaattggatggaccattaccacggtctttggcccactgcacaaagctggaagttttggacctggcagacaataacatagaggatacatttccccattggctagaaagcctccagcagttacaggtactcagtttgcgatcaaataagtttcatggtgtcatcacttgtttcggtgccgagcatccatttcccaggctgagaatttttgatgtctcaaataacaattttagtgggcccttaccagcatcatacatcaagaactttcaaggaatgatgagtgtgaatgacagccaaactggtttgaaatatgtgggtaacgacaattactataatgattcagtagtggttgtaatgaaaggtcgatccgtggagctcgagaggatattaactattttcacaatcatggatttatcaaaaaatatgtttgaaggagaaattccaaaagtacttggagaattgcattctctcaaagggcttaacctttcgcacaatgcaatcactggtaccataccacaatcctttggtaatttaagaaatttggaatggttggacctctcgtggaaccagttgaaaggagagattcctgtggctttgatcaatttgaattttctggctgtgttgaacctttcacaaaaccagtttgagggtatgatacctacaggtggacagtttaacacatttggaaatgattcctatgctggaaatccaatgctatgtggattccctttgtcaaaatcctgcaaagaggatgaagaaaggccaccacattcaacatttcaccatgaagaatcaggatttggctggaaagctgtagcagcgggatatgcatgtgggttgctatttggaatgcttttgggatataatgttttcatgactgggaaaccacgatggctcgcgagacttgttgaaggtgtgcttaattaattaagagtgaaaaggacaaatcataggggaaggaaatagtttactctaagtttattatggttattttgtgtgtttctttatgttttctgtaattttaacttctgtctgtggaagaaatatcgtctctggtgagtgatctatttcaagttgtttccaaataagaaaaaaatgtgatgaatgctttggttccaatttcaagcaattaattttccgtaaattggcattatattaggaacatatatatataattctctggaagaattttggctaacacaattaaatgtacaattgtatcattgtattttcagatatagttagttcatgatgaatgctgttcagcatcaaagctactgagaaaagaactagaaaaccaacctttcggtagttttagaattcactgccgatgaaggttctgtgggtcgtgtctttttctttactaacagcactacagaaaagtccattagtttaagatcggtatgtttttgcttagtgaaaggactttatgccaatactccaaccagaaagagtaggattttcttatttgcaaaaacacaaggctatccttgaaacaaatatttaatagtaaacgatggagaatttgcatacaagtggcttcagttaaaaccttctttcaactctctgttctacaaacagatattgaagttgacataattgatcctgatacagcctctggaaagactgatccatatgcattacaaaatttctagacaaaggcaccagagggtaagcatgttcttgaaattaagggttgaggtaacattagaatcagataatgtacctcaattgttttttaaaattaaaataaataaataaacataatatcagagacaaatgttagtgatcagaggatgagagggatacatatcacaggcataggccaagtaatggaacaaatctcaagaggttgcacattgattgataaaaatacagagaaggtatacggtgctctttttatactatctattaagcgactaacaagtaattaaccataataaattaagtgattaactaactctaagtgaattttactagtctcctaataacacacgtgggagacgataatcttttcattcctagcgagaagatatcaaaatgagtgatcatcccatattattggctcaaagactttgatgcttatctccaaagataaaaactcattagccacctcttgaatacagacatataccgtgtcacaaatgccatagtacgagctatgactaaaagtggacttttaaattaaaaattggtttcacctacccctgttattacctactttctgaaaacaacaatccctaaccaactcagtccaattattgatatttgaaaatattatagatgatgttttgtaaagaaaattaataaatactatatttaaatctgcagttagaaagactatcagtttacgaggatttcttttaggaaatttttacaagtctttgacgaggtcaagacttaaatttgaaataggaaaatgataagataaatgagaaaggtaattacaaaaaagtagtagaaattaatttgataatagatttaattagaactaatttaggaataaaatcattctagaactgaaatagtgactaatttttttttaagagattgatttgataacttatgtttttttttttaaaaaaaaactaatgcaatctactatgtaatatgagagaatgtcacatgacatttccatattcatttcctccaaaataataaatttaataataaatacaattgatatcatttttattatttattcattaatagtagttatcttttaaatagttacctttattacaatatatttttttcaggcaaattaaaaaaatatttttcaattaaatttttgcacgtactatttaattttaattttttttatataagttttattttatatatattttagttcgacaatagtatgacaaattatggtatccatgataacgattgttataaaataattatacaaaattatttaataacattttttactatactaaaatgtaaaccttgcaattaaaaattataaaagattgtattattgatgaannnnnnnnnnacttaatatatttttggaaataattcaatttcaaaggaaagatatcataatgcaaatatatatgaaattaaattttaaaataatttaatttaaaatcaatcaaattatgaagtatcaattcaaataattaacattaatatattttattttctccttcccttccaaacaaaatgaaatgacattttttaataacattttttatactgtaaaaacatttttttgatgatgtttgaaacttaaaaagataaattaaataaaaaagaattctattgtaattaaaaaatttcactcaatttttattatccgaaatcaagcatgtaaatcattaaaaaaattaaatcattttaaaaaaaaaagataaaaagaagacatgtaagatatcattatagtaaacaaagatttaatctaaaataatgctccaaataataacattttttgaaacatgtatgtatataaaaatatatttaaatatttcttaaattttttactaacatatatatttattaaaatttaaactaaaaaaattaataatatattaaatcttggttgtggtggtgaaagaacaggttaaatttctactccccaaaaaaatatactaaaaaaatatacaaataattgttgaaaaaaataactttgccaataattttgaagtaattccatcctagctctataaaagtatatatcaaataaaaaaatgaatgtaagagaaaaaaaatatcatctatatacttaaaataaataaataaattataactaattaaaataaagtattttcaaatttaactaaaaaggtaacacttgtggaataaatcacattttttttatatataaatatttcttaacgataatcatatatcactaattaaattaatttatgatgtattgaattaaaagatatatatagaatcagtttggatgtaacattcacaagtgtagtatttggactgcaatcataaagtgaaccaagataaaactactattttgtgctctcttttttttttcttgcaatattcattattattcaggaagaagggaaataaatcagtcagaccttatgcttacaaggcacccagatatttgggagttccctgaattaccaaacaaaatgtgtcacaatgaaaatattataggtttataacctttaggcgatgtggaatctaacggctcctcgcgccactccctattcgtcaacgtcgtgatcggggccgacggctagccgcgtcggcgactacgccgcgccatcgcgttccaggagtcttttttatatttttatcccttttaaatacaaatatttaaaactaattaattctaattaaaatttgatttaaattttgattttaaatcataaactatataaaacaaagatttttatttttataaactatatttaaaaattattgtaatctttgttcatctcaattaatttttgaaatttgacatactattttaataaaaatgacttgtcttgattcaagtaatttatttatccctttaatttattatttaataaaattgattatttattaataataatgataacatttattatttttatttatatataatataagtatgtatattttgcaaccattttttcttctttaggatcatacatgagtacacaaagttaatgataacaatgaaataagtagattagattgacaaactcatatcccaaagttaaagaaaatgtttgtcttcaaacatttaaaaagtggaaatacttcaaattccaaacaaaattttattaatcattctaatgaaaggttaacataatcagtaaaaatctaatcaatctcaacaaaagggatttagttaatataaagaaaattgaagaggaaaaaaagaattatacagatacttaaagagacatgatttactacttattacatccagattcaaactcacactaattaatttgataaccaccatagaactgcatttagcatgatcacaaagttctcattcattatccttgaactggtgtgaaatatattgttatttatcttaaaaagttttttaacatcttgatgaagggaagtctcgacaatactacccatattatttattgtttattttaggaatattattttgctcacggtgtagaaggcaatctaaaaagttagtcaagcataatagttatcatttataattctttatagggagtttctagtgtctttaactcaaaagcaaaactcaaaattaaagttgccaaatataatacttgtcatttctttaggatttttttacacgtcaaacgtctttgtcgaggtcaagacttaaatttgaaataggaaaatgacaaggtaaatgaacaaagcaataaaaaaaagtagcagaaattaatttgatgatagatttaattaaaactatgatagatttaattaaaactaatttaggcataaaatcattggagaaaagtgaataagaaattttttaagagattgatttgacaagtattttttttaaaaaaactaatacaatctactgtataatatggaaggatatcacgtgacgcttctatatttatttcttccaaaataataaatttaatgataaatgtaatcattaataattgttatcttttaaatagttaccttaattataatatatttctttcaggcgaattaataaaaaatatttgcaattagttttttacattaacttttatatgaatttaattttaactttttatataatttttatgttatgtatattttagtttcataataatacgtcaaattatggtatccatggtaacaattgttataaaataattctacaaaattatttaataacattttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatattttttaccatactaaaatttagactttgcaaatgaaaattatacaagattgtatgattgatgaaaaaatattcctccgtgaatatttgattgaattttaatcacaaaaaatatttatttattttaataaagtttcatttcttataacatttattcatgaaaatatttaatgaacaaattatttttgaaactaatttaatttaaaatagaattaaccataagaaaactaaaagcaaagtttatgtggaaaatgacttaatatatttttggaaataattcaatttcaaaggaaagatatcataatgcaattatgccaatatatatgaaattaaattttgaaataatttaatttaaaattaatcaaattgtgaagtatcaattcaaataattaacattactatattttattttttccttccattccaatcacaatcaaaactaaatgacatatttaataaatttttttactgttaaaacatttttagatgatgtttgaaacttaaaaatataaattaaatacaaaacaattctattgcaattaaaaattttcactcagttttttgttatccaagatcatgagtgcaaatcataaaaatattaaatcaattttttaaaaaaaagatcaaaagaaaatatgtaagacatcatcaaaataaataaaaatattatctaaaataatgcttcagataataataattttggaaatacatgtatataaaaatatataaaaatatttcttaaaatatttactaacatatatttattaaaatttaaactaaataattaataatatattaaatcttggttgttgtggtgaaagagcaggttaagtttctactccccaacacacacgaaggaacaaacgctaaaaggaaaaacgcggggccataatttacgcggttagattgtcaattgttatcattattcatgatttaatgttcttctaactttagaatttaagttgtatattttatcactataaaaagctctttactttatcactatagcgtcttggtcttggatgtgatattgagtgctcatcgctttttaactttctttttagctagttccgtttcaaagttgagagagattttaaaagtaccataaatctctcaaaacaacaaattcttctttattagttttgattaagctaatattttctcttattcaaaaataatttttgaacactcgatcaaaacgttagttaacacatgacatctactaagaaagagattatatatatatatatatatataagtgatataatatgatatgatagtaagaaaatagagaaaaaataatgagtgttacttttgtgtttacaaaaataaaatnnnnnnnnnnnnnnnnnnnnnnnnnnnnnnnnnnnnnnnnnnnnnnnnnnttctattaaagaattatcaaacatgttacttgtcattaaaaaatacgaactagagaaataacaaaataaatgaaaaaagtagttacataaaaaattgaggaattaacttgatactagactaaacttttttgtttttgcggacgatagactaaacttttaaagtcataaaataattggagaactaagatggtgacgaagaaatcttaagagataacttttaacaaattttttgaaaaagaaaactagtgtgataaccaataaaattttgaagaaataaatttaaatatttctctttgtaaaagtaaaaaaaagaagacaattttagtaaccttttaattatttgttatagttatgtttaataatcaatttacaactcttagtgtaattaatctgtttttgtattataattcgagttcttttattaaatgagagtgtttttaagcatggttatttttgagtaaatgattcaaatcctaagattatggagaaaattatgaaattgtgaatccatggaattaacatattctcttcaagactaaataaaattatcatattttttaggaaaaagggtttggtttcaccaacacaatcacatgaataagaatacaacaataataactgttttagaccaacaacctccattgactcactctcgttaaacaacctttacgaggagtgcattgaggaagttgtccctccaatgttcaaagcaaaaacaatattaaagaatgaattttgggtttcactaatgcgataacaaagggacgaatgcagctacaacgatgaaggcagatcaatcacctttatgaaaataacaaaatcactttccctagggtgtgaaggagaaggggtgattttgtgcagtagccacaataattgggtcttcttttttcctattccctaatttcattcttttttatttgatttaaaaaatttcttctggttttttactttttattttgttaaaattgtttaataataaaataatatttttttaatccatgtcatggttatttgatggggatcacccactgtagagtgatttgcttaacattttccttaaccaaaaacactataaatgaagtaaaaaatataacatctagaggaaactataattaattttaacattgttacaataatcaattagtagcaaaattataaatatttaaacgttttaatggttggcaatataaaaaaatatctaaataacagaaaattattttgataatgatttagaaatatattattatattaatatcaactgagtaaaattaaacattcattaaatattaaaaaagtgaaaatatttcttaattgaataaaaataaaataatttgataaaaagagaaaaaataaataaaggtaaaaataatgagataaagtaaaaattaagtgcagctttataaatattattttcatgaatttcttacaaaactcatttgtgcgctttaaaaattaaaaattaaaagcgcctttataaagctagacatgatacgaaacgcagcagaaggaaagaaaaagcaaagaaagagttgaagcgtaggctataaatagaagtttgtgaattgaattgagtgtatccaaaaatcctgtctagttttgttgttgttttgaaaggatgaatatgaataagaatgtttggtggcttctactcccatacttttgcttccttcttcttcttcttcttcttccttgttcttcttcctctttctgcaaccaccatgacacctctgccttgctacaactcaaatacgcactcaacacaccttccaaaacagcatcttggtacaacgacacagattgttgtgagtgggatggggtcacgtgcgacatcatctcaggccacgtgattggtcttgacctgagcagcagtaatgttcaaggtcaactccttcccaacagcaccatcttcagcctaagacaccttcaacgactcaacctagcctttaattatatttttggtgacattccctccacaatctctcacttgtccaaattactgtcacttgatctaggtaacttcaacttgatagatgatgatgatcccaactacccgagaatgagaattgatccatacacttggaagaaactcattcaaaacgcaaccaatttaatagagcttaatttagatggcgtggacatgtcttgtatgggagagagctctttgtcattgctaaccaatctctcttcctctttgatctcccttagtcttcaagacaccaaattgcaagggaatctatccagtgacatcctctctttacccaatcttcaatacctatatttggatcataataaagacctcggaggtgaacttccaaagtctaactggagtactccactaaggtacttggatctctcttatactgctttctcgggaaacattcccgattccattggccattttaagtctcttaacacactatctctgtccgattgcaattttgatggactgcttgcctcatcattgtttattctaactcaactcgtctatttagatttaagcaataataaattagagggaccaattccaaccgaaatcaataaactttcaaaattatggattctatatttgtatgataacaagttaaatggaacaattccacgttggtgttattctttgttagagttggatcttagcgacaaccacctcacggggtcaattggtgaattctcatcttattctttggaatacttgtcactctaataacaaactgcatggtaatttaagtggtcatctggactttaatcatttttcaaagttaaaaaatctaaattacctcgatctttctaataatagttttctctctattaactttgatagtaccgctgacaacatcttacccaaccttgaacacttatatttatcttcctgtaatattaatagtttccctaaattcttaccaccacttcaatatctggcccgactagatctttctcataacaacattcgtggaagcattccccagtggtttcacttctggaataacattagttatattgatctcagtttcaacaagttgcaaggagatctcccaattacacccaatggaattgaaaactttttagtctcaaataatgagctgaccgggaacattccttcagcaatgtgcaatgcaagctccctctatatactcaacttggctcataacaacttgacaggccagattcctcaatgccttggaacatttccttctcttttggcattggatttgcaaaagaacaacctttacggcagcatacctgggaatttttctaagggaaatgcattggagactataaagttgaatggcaaccaattggatggaccattaccacggtctttggcccactgcacaaatctggaagttttggacctggcagacaataacatagaggatacatttccccattggctagaaagcctccagcagttacaggtactcagtttgcgatcaaataagtttcatggtgtcatcacttgtttcggtgccaagcatccatttcccaggctgagaatttttgatgtctcaaataacaattttagtgggcccttgccagcatcatacatcaagaactttcaaggaatggtgagtgtgaatgacagccaaactggtttgaaatatatgggtaacgacaattactataatgattcagtagtggttgtaatgaaaggtcgatccgtggagctcgggaggatattaactattttcacaaccatggatttatcaaaaaatatgtttgaaggagaaattccgaaagtacttggagaattgcattctctcaaagggcttaacctttcgcacaatgcaataactggtaccataccacaatcctttggtaatttaagaaatttggaatggttggacctctcgtggaaccagttgaaaggagagcttcctgtggctttgatcaatttgaattttctggctgtgttgaacctttcacaaaaccagtttgagggtatgatacctacaggtggacagtttaacacatttggaaatgattcctatgctggaaatccaatgctatgtggattccctttgtcaaaatcctgcaataaggatgaagattggccaccacattcaacatttcaccatgaagaatcaggatttggctggaaagctgtagcagtgggatatgcatgtgggtttctatttggaatgcttttgggatataatgttttcatgactgggaaaccacaatggctagcgagacttattgaagttgtgcttaattaattaagagtgaaaaggacaaatcataggggaaggatatggtttttttgtatgtgtctgtatgttttctgtaattttaacttctgtctgtggaagaaatatcgtctctggtgagtgatctatttcaagttgtttccaaataagaaaaaaaatgtgatgaatgctttggttccaatttcaagcaattaattttccgtaaattggcattatattaggaacatatatatacagttctctggaagaattttggctaacacaattaaatgtacaattgtatcattgtattttcagatatagttagttcatgatgaatgctgttcagcatcaaagctactgagagagaagtagaaaaccaacctttcggtagttttagaattcactgccgatgaaggttctgtgggtcttgtgtctttttctttactaacagcactacagaaaagttcattagtttaagatcggtatgtatttgcttagtgaaaggactttatgccaaaactccaaccagaaagagtaggattttcttatttgcaaaaacaaaaggctatccttgaaacaaagtatttaatagtaaacgatggagaatttgcatacaagtggcttgagttaaaaccttctttcaactctctgttctacaaacagatattgaagttgacataattgatcctgatacagcctctggaaagactgatccatatgcattacaaaatttctagacaaaggcaccagagggtaagcatgttcttgaaattaagggttgaggtaacattagaatcagataatgtacctcaattgttttttaaaattaaaataaataaataaacacaatatcagagaaaaatgttagtgatcagaggatgagagggatacatatcacaggcataggccaagtaatggaacaaatctcaagaggttgcacattgattgattaaaatacagagaaggtatatggtgctcttatttatactatctattaagagattaacatgtaattaaccataatgaattaagtgattaactaactctaagtgaattttactactctcctaataacacacgtgggagacgataatcttttcattcctagcgagaagatatcaaaatgagtgatcatcccatattattggctcaaagactttgatgcttatctccaaagataaaaactcattagccacctcttgaatacagacatataccaaagtcaccataacaatgtgttaggaaaaactccacctcacacaacaaaattacccactcaccctagggatcttagatgatttttttttttcttctcttggatctatatatagagttaaataacaatacaatattcaaatattatcatcatcctaaacttaaaaaaatcctaaaataattaaatctagataaaatcttcaacatttgaaatataacaaatttctaaaaaaatctcctttaattttctcctgctccatttattttgaaatttaaattgttcttcaacaattcctccctcaattaaaatttctaaataactttttttttttaaaatttctccaacttttctgtcctcacaacaccaaatgtctctccttgtagcttacatcccgaatttaaaccaacatacttatatccttgtcatgtcatctctcacaataaaattagaaggtacaactctctcacattttgaaaggtttctcctagccatataacatgctttctccaaacaactatccctatcaaactcagaccaattcgatcttgattaattttgctgcatggttgatatgaaatccaactcaccaagactcccaccatcatcataaggctcccaccatcatacctttcaccaccaactcacctccataattcaagttttcttttctttatttaattgtaccactttctttatttaattctagaattactactataaataggagtatcatcaagcattgtaacacacaacaattcatttgaatacaagaacaacaagttcttctcttttctctcttttctctctagtccttttagttcctgagccatatttggcatcagagcaaggttccagagtcaagggaaagcctgaattcgagccagaggttcactttcgagttttccggcaaatttcaattctgccaaacatcgaaagtcccatctctgatcgtttttttgggaaaactgacatcgccaccgccggaagtccacgcgccaaagtgaggaggtatcgggttcgtaagaaaattcttagtatgctctgtggttgcagtttgtctgatcttccacatcagaaaagaattattcttgttgctggaaataaagtgtggtagtgtgaaaagtgcatgtctagaaagttctggctaaggaaagacttggtatttaagtgtgtccatttgtgacccacctctctttcctgggaacttacctggtgtactattttacagactacgatcactgttccagtttgtctctcacggtactatctacggaatccacgcgacgccatgcgccaccgccggaagtgccacatcacctgccacgtcagccactcatccaatcaaaaactgtcacgtgtcagtcaacgccacgtcagccaatcaggtgctgccacgtgtcctgatcgtgtaagttttcaaaatttgcagaaaagcccctataaatttcagaatttaattttcagtccctacacttcattaaaattaccatttaacccctgcacttcctaaaattaccaatttatccctacaccccataaaattaccattttgacccctactaaaattactattttacccttactctaaaaaaaaaaatatcattttaccctcatacctataaatttaccaatttatcctcatactttctaaaacccatataatggcccctagacgcagaccagttcacgaaaccataattgaagaattgaggcaacaaattgaacagttgcaagcaactgtaaatgctcaacaaatacaactagaggagcaaagagcatcccaaagctacgattctgaaaatagtgattccgcatcgaccagcaatcgtcgaacgcaaaggcaagccttccgatcagacgatattagagtggaaatcccagaatttgaagggaagctacagcccgatgattttgtagactggctacaaaccgtagagcggatattcgagtataaagatatacccgaagacaaaaaggtcaaaattatcgctctcaagttgaaaaagcatgcttccatctggtgggaaaacttaaagaagaagcgagcaagggaaggaaaaagcaaaatccggatcatgggaaaaaatgcgaaaggaattgaatcgtaagtttttacccattcattttgtccaagataattttattcaactacaaaatcttcgccaaaagaacatgtctgtagaagaatacactagggagtttgagcaattaatgatgaagtgcgacattcaagagagagagaagcaaaccattgcccgctaccttggaggtttaaatgctgatattgctcaacaagtccaacttcagcaatatgaaaccgtagatgacgctattcgactatccatccgaatcgaaaagcatcagcccagaaggtcttcatatcaacctttctcctctttcccctacaggaatactgcaaatactcgcagaccacaaacccaacaacctagcacaacaaatagccaacaaccagtccgaaaccctcgtgcgtccaacaaccaacaacccaacacctccaacaacaaccccccaaaatccaatacagaggtcaactcgagagtgaccaaatgtttccgatgccaaggatttggacacattgcttctaattgtccaaaccgtagagtcattaccatcattgacggagaagcccatgaagtttctgaaaaagatgaggaaccaatctttgatgaagaacccatctttgatgaggaacccgtatatgatgaagaaaccacccctgctgatcaaggcgaactactggtggttagacgtagtctgcatacaacggcagttaaagaagatccgtggctaaggcacaacatcttccacacccgctgcactacgcaaggtaaaatttgtgacgttatcattgatagtggaaattgtgaaaacgttatatccacttacatggtggagaagttgaaactgccaacacaagaacatcctcactgtaacgccctgaaatttcggtaaattcaaaatagatgcttaatgtgattgttttgttaattgtttgataagtttgtatgagttgaatgatggttgttctattgcttggtgtagataagttatgtggagatgggtgatatttacgtaattaaacggatttacgtaaacggatatacgaaagggcagtttggtcattacaagaggtatgggtgtagttagtaagagctgggtgtcgttagcaattactgtagcatcacggatttactgtagcttcacggacgattactgtagcaggtgaagttagtaattgctgggtgcagttagtaattactgtaactgtagcttcacggaccgggttactgtagcaggtgaagttagtaattgctgggtgcagttagtaattactgtaactgtagcttcacggacagggttactgtagcaggtgaagttagtaattgctgggtgcagttagtaattactgtaactgtagcttcacggacgattactgtagcaggtgaagttagtaattgctgggtgcagttagtaattactgtaactgtagcttcacggaccgggttactgtagcgtactgtagcttcacggaccagggttactgtagcatactgtagcttcacggaccgggttactgtagcatcacggaccgggttacagttactgtagcagttactgtagcagtctataaatatgcggaagctgcggaaaattttgcagaaactatggttcctcctactatactacagccagtttcacaaaatcttagatcttgaaggggaattaagtaattcacggacgttgaagcccagagaagtgattctctagctctccacgattgtcttgagagctcttggttaggtaaggggagtttattatttagttatagttttgataccatagttgggggccagggagtccaactatgaaagataactgcctgtccctgctgtgtgctggttttcaagaaaaactgtttttaactaatgggatgcgataaattggttggttgatggataaactgtgaatgatattattactgtgatgattgaatttttgggaaaagtcctaattacagaggagactctgcccaaaattttataatatgttttcctatttaattctttattaaatttttaaatgggcagaaaagtggattttctatattgcattcctcctctttaatttagaattttcctaaaataccagtctcgtagtaatgtggattatgaatgaatgaagtgatattgatgtcattgataatgttgaaatgattattgatgtgtttgatgatgtatatatgatatgtatgatgttgatgtgaatagtgtcattgtatgtggatatacatggatacccatggggggtgtatgacgggttacccttgcgaggaaggatttgttcctagccaggtcatacattgattgtgcccatggttgtaggctgtgtatgtacacgtgggatgccatgaccggttggttacccttgcgaggatggatttgttcctagccacggtcagtgcatcggtgagcccacattggtctgttatgtatgtacatggggggtgcatggcgggttacccttgcgaggaaggatttgttcctagccgggtcatgcattgatgatgcccatgtttcatacttcatttggatgtgtggaaatagaatgaaggcactcgcgtacctgtgagtttcagtgggctgagaacgcaggtactaaggggtcatcaggtttggaattcccttgctacgctggctgatcactgggtgggggaatggccagtgcacgacagggtggccctaataggcggtgaatcatttgtcctgtgagaggctatttccggtgatggtaccacattgcatgctgatagatgagtcaggtgcatgcatcattctttgcataattgtttgagttgtgaaatgcatgggatgattgatttgttgagggtgtattggaattatggatttcttttgttaatgattgtggcgagtaatgttggtttttcctaattgctgctatctgatattgtttggtttttatatgataaactcacccttgcatttgttgtaccgtgtggttggtacctgtgatgatcacgaacttttgttcgtgggagcagatgatcagcagtagatgactttggagggagatcttctttttggttggagccgccaagccgacgtgatgacgttggatttctttttggagaaagagttgtgttttgttaaccaactctttcttaattaatctttggctgtttgttggtatgtaattttgggtgtatatacacgtaaattaaaggaagttatgacatgtggatgacatgtactaatttaatatatatgtataatgtgtttaaatatgtaattgtaatatgtgtatgataattgtattatcgcgaaaaatttaccatcgttttcataaataaattaatgaagttttattaaaaattgaagttgtacgattaagagttagtgatatcgtagcgacgaggcgggtcgttacactcacccctacaaattacagtggcttaataaaggaaatgaggtgaaagtttctagacgatgtcttgtgaatttttccattgggcagaaataccaagatgaaacttggtgtgacgtaatccctatggatgcttgccacctcttactaggaagaccatggcagtatgaccgtcgtgctctattcaacggttataccaacacttactccttcatcaaaaatggagtaagaatcaagttaacacctctatccccaagtgaactaaacaaggggaagaaggaatcaaagcctctcgaggttctcatttccaggaagcaacccaaattgtccacagaagaagctcataacacgagccttatcctcgtgtgtgaagccaacaaggaaacagttcttccgcaggagattaaggaaatactcgctgattttaaggatgttgtacctgatgagattccttatgggttacctccagagcgagagatccagcatgctattgacttcatccctggagctgtcattccaaataaaccggcgtacaggatgagtcccaaagaacacgatgagattcaacgccaggttgaggagttgcttaaaaaaggattgattcgagaaagtgttagtccttgtgcggtaccagtcctcttagtaccgaaaaaggatggtagttggagaatgtgtgttgatagccgagctgtcaacaaaattaccatcaagtatcggtttcctataccgcgacttgatgatttgttcgaccaactgcatggagctaccctgttttccaaaattgatcttcgtagtggctatcatcaaattagaattcgtccaggagacgaatggaaaactgcattcaaaagcagagatggtctctacgagtatacagtaatgccttttggtttatccaatgctcccagtactttcatgcgcctgatgaaccaggtacttagaccttttattggtaaattcgtagttgtttactttgacgacattttggtctatagcaaaagaaaggaagatcatttggaacacattcgtcaagtcctacaaacactacgagagcaaaaactctatgtcaatatgaagaagtgcgcctttcttactaatgaagtaaacttcctgggatatgtaatcaccgctgaaggcgtacgagtggataccagcaaaatcgaagccatcaacagttggcctattccaaagtctgttcatgatgtaagaagttttcatggcttagcttctttttacagaagatttatcaagaattttagctccattgcttcccctctgacggattgcatcaagggagataaattccaatggacagaacaggcccagaaaagctttgaaatgctaaagaaacgtcttaccgaagcaccactactagcccttccaaactttgaccaagtgttcgaggtcagctgtgacgcttccaatgcaggaatcggtgctgttttgagccaagaaggtcatcctatagcctttttcagtgagaagctcaccaatggtcggctcaagtattccacctacgacaaggagttttatgctgtagttcgtgccttacaacactggagccactatctgttgaataaagaatttattctttattcagaccatgaagctctcaagcacttgaattcccaacagaagattaatcgaatgcatgctgcctggagtgaattcttgcagccatacccattcctactgaagcacaaggcaggagttcaaaatgttgtagccgatgctctcagcaggcgacatgcattactctccactctccaagcaaaggtcatcggatttgaggctatcaaggaattataccaagatgatcctgactttagcaaaatttggaatgtgacagaatcacaacccttccaaaagtactaccagcatgaagggtttctgttcaaagataaaaccctgtgcatccctcaatgctcattacgggaagcaatcatctgggaagcccatgacggaaatctagctggtcactttgggcgagacaaaaccgtaggcttggtaaaagagaaattctattggccaagactagagaaggatgtcaacaagcacattcaaaggtgcaagatgtgtcacatagccaaagccaagagtcagaacacgggactgtatatgcctcttccagttccattagcaccttgggaagacgtcagcatggattttatccttggccttcctagaacacagcggcagaaggactccataatggtggttgtagacagattttctaagatggcccactttgttccgtgtcagaaaaccaatgatgctgttcaagttgcagaattgtacttcaaggaaattgtccgccttcatggtgttccaaaaaccattacttccgaccgagatgttaaatttctgagtcatttctggagaaccctttggaagaagatgggtactaaactacaattcagtagtgctagtcatccccaaacagatggacaaaccgaggcaatcaacagagtattgggaaatcttcttcgaagtttcattgggaagaatttaaagcagtgggatcttcttcttgcacaggtcgagtttgcctacaataattctgccaatcaagctacgggaaaatgtccattcgaagtagtttatggaactcgtccgctcagtccattggatttagccgtctcgcctgacactcaatactacagtgcagaagctgaagaaagagcaaaggaaatcaagaaattacatgagcacgttcgtgatcagatccagaagcagaactctaagtacaaggctcaacgagataagcatcgaaagttacaaactttcaaggaaggagacttagtctggatccaattacgaaaagaacgatttccaaatcagccaaatgccaaattatctccaagagcggatggcccgtttcgggttgttcaaaagatcaacgataacgcttacaagattgagctacccggttcttacggagtgtcaactacatttaatgttgccgatctctcaccatacttcaaggaagaagaattcttagactcgaggacgagtcttttccaacctggggagaatgatatggaatccaactcaccaagactcccaccatcatcataaggctcccaccatcatacctttcaccaccaactcacctccataattcaagttttcttttctttatttaattgtaccactttctttatttaattctagaattactactataaataggagtatcatcaagcattgtaacacacaacaattcatttgaatacaagaacaacaagttcttctcttttctctcttttctctctagtccttttagttcctgagccaatggtgatcgtagatgcgcccaagccaatgtgtcaccataacatcaaagtcaccataacaatggcctggtaatgttctaaaggctgccacgtttcatattttaaagttgaaaagatattgatagatatttggaccaaaaaaagaaacaatattgatcatactaatatgcacacagcagacgactgaattgatcttgaaattaaaaacatagtccttcttctgaaatttatataccctagcaatgtcgtccaaatattgaaaacaattttataccctgatactatatatattcagattctattattcagttttttcaaaaaaaatattggaaacctattaaaaatttatatcaaaagataaaataaataaaaagcaatactaacaatatactcttgtttaacattttttatattatttgctaaatttgatgtgaattctattacaaaatttgatgatgggatttacgtaaaattcactcaatgattaaagatttgtcaaaaggactttctagcttttcacaactgccaaagagttttacagactccattttggcgtcttaaatccatttgttaaacgtaattttttcctttaaaaaatggttcacgtgaaacgtgagtcacactctctccactttaattaaacattctcatcatctagattctggatgtgaatttcacacattattactgtaaattaaaacatctcaatctgtcatttttctttatctgtatttttatgtttaaacatcttaatagtttgtctcttttcatctactatattttatcactattttaaaattgaatttcaatagttcttataaaaataaattatcaatagttaaaattaatattatatcataatttaaattattcattataaatttaaaatataatttatatattaaaaaattgctgaaacactttttattagctgaattttaaaattatttatttatgatggattttaatgctataagaataaatttaatatgattctttcgtgtgtgatgcgacttgttttctgcaattttaacttttgtcttttgtggaagaaatctcacctgagtgatctatttcaagttgtttgcaaataagaagaaaaaaaatgtgatgaatgcttttgttttaatttcaagtaactcattttccgtaaattatctagggtaacctgcataagcatcaagcaaaatttgcacattgaaccttcaatcggcacacagttggcattatattaggaacatatgtactgtttgctggaagaatttaggctaacacaattagatgttttcagatgtaattagttcatgatgaatgttgttcaggcatcaaagctactgagaaaagtagaaaaagaaaattgaaaatgaaagtaacataagaataaaaataattaaatttttatacaaggtacttagctccttaaggttactttctagctagcatcattccaaagtcttccttttattttggctgcatcttatttctctgcttcatactcttgtgggttgctatttggaatgctcttgggctgtgatgtattattttttaaaatccaatccatgaacacccgtaaccttcatgatgtcaaatttacactacctaaaactctcaaatatacaagtttcataaacaaaagtttcagaacatttaggggtagcaaataattgtaaagccatatgctagctaggcctatgcagtaattttttttataaaagaaatagggtgctacggcactgcaacactgttgggtatgctttggaaatcatttctttattagaacattaaactatgcatttacaatattaaataataacttgaaaaaaaaatacccaatatatatacaactttactaaagaaaatgtaattattaatatattattactaaatcacatggaaggaacaaagtagaaaaccctaaatcacagatattgatccaaaatcctaactctctccatggctgcgaaaattcaaactagtttttgtttacctacattctccattccaacctcaaaagcctgcttaaactcgttcaccatctcagcctccaaatccatctctggccgaaagctccgggcgacaatgattgatggtggcctcgctggatcctccgcagcagaggccctagcctccgacggcgtccagacctttctcttcgaacgcaacccagcgtccgtcatgaagccgtgcggcgcgccatccctctctgcatgctcgaagagtttgacattcctcaccacctcatcgaccgccacgtgacgttcatgcacatcttctccccttccaacatcatcgtcgacttctgcaaaaccctaaaaccccacaagttcatcgccatgctctgctgcgaggtcctcaatcgactccttcctccgctcccgcgcacatgctgcagagggttttctacgtagtaacgtgtccaggaaggctttggtggaactgtgtggggatgagtatgttcaacgcatgatgtttgagaactatttgtataagaagttggcacgtgggagagtgttggatgatgctaagcttttcgtcaataccattgggagcttggtgagatctaaagtattggaaacaccaagcatggagagtttgatactatgacttcggaaatcccactaagtgcatgtagcttctgcgtcatttttacgtggttttgctgcttgaacgttgatccaaaacgtgtttccaaacatgttctaaataatttgtttgtgtaatttctgtgtactgtattattatgtaaccttctaacggaggcacttttgaatttgatgggatggtggattgatcaccaattcaccaacacttctttaagaattgttttattcaaatacaaaagaacagtatacaaaatttcatttgttgatgtcataattcaagggcttaagtaaagcaacaataaacttatacaagaatgagcttatctatccgtctaatcacacatcgaagacactgtccttcaaccgataaatcaaaggctttgttgatatccttgaactccacctcgtgtgtgacaaacccatccaaattcagttcctgttgataattgcagatgaaatttagtaccaaacaaatgcatcctgaaaactttgttttatggcattattattttacttagtcatcactatgttaatagaagggatcaagagcatagactgaaaaaaattaaaagaaattgcacaaagtaccttgtccaggtagcgtttaaggagaataggtacgtcagacttgggtttgagtcctccaaataagcaccccacgaggctcttcccactatggaggacctcattacaactaaggctcaacgtggatcctggcttgtccactcctaaaactattgtttttccccaaccctgtagggaaagcatcagttttaacaacattcaacaagtttgcatctgataattaagagtttattattaaaatttccaatcaaacctgtctcaatttgacaggaaacttcattttcatcaagtaccatgaatttcaaattagttagcacaaaagaaaacctattactagtgctacttttagtgctaggttgatcctttaaaattattctgcagttattcattcaatcacattactctgtcggcctataaaccatcttgcaaggcatgtttaggggcactttgagagagagatagatagatagacaaatagatagatagagggagagggatagagagagagagagaggagagagacctttttgcaagaagcatatgcttcttgcaccaatgatgccattccaacacattcaaagcaataatcagctccccgccagtcatctctatgataacctgctaaacaagcacatatgagaatgaaatttcaagacttaaggcaactaaattaaataaagatcggagcctagaagagggtagacctggctcacagatttgagcacaataatgacacaaaacaaatttgtataagcattatcattaagcagataatgcattaccagtttcatatttttctgggttgaaatccacacctataatcctagttgctccacaaagtctagctccctcggcaacctaggaaaccagtcacttgctatgagcgtttgagtataataaaccacaaaacacacacaaaaaaagctatgtggattccttactgctaatccaatacttcccaacccaaaaatggctactgtagaccctggctccacacctgctgttctccaagcagcacctacccctaaaagtgcaagtttaatcaaaatactgaattagatgaacgttgttgagtagtgaattaaaatgtgaatacaaccatgtgtttatttatgataagatattctgactataatttttattatgcaactgatatagttcttcaatattctttttgtttaatgtttacaattttgcatggtttaggcaaattacatgttgatacaccacaactaagtaggcctgccctgttgggtggtattgctggatcaatcctggttagatgagcaatgtcaaccacggtatactcactaaaactagacgcaaacaagaaatggggtatgatatctccttttaaatccgtgaatctagaggtggcatgtctaggcatccaaggagacacctcgaaaggaaacttcgaacaaaggttgctcttgcttgatttgcaatctatacaatccccacaatcaggtaagaaaattggaacaaccacatatccttttgtgacttcggttacatcctctcctacgctttccacaaccctggatcatatcaaaattagctagaacatcatcatcagcttctataatataatatgcagaagatataatggggctcaaggtggcaaatcgttggcaaccaacacaaaaataggtagcaaagataaatataattagtcgtagaatttgttcttaaatcaatgtatcgattactgttgttaaatcatctgaaggtttgcagacacactttgctttgtaatttaatccttgatcaaaattgaaacattaaaatttggctcataactatccaatcttttctctaggattgaatttagaaaattaacaactcctgatagttagaccacaaagatgcctctaaacaattttagcatgtgtaacacagaatacctttttttttattattattttgaaaggaaaaagtaatgtattgaataaaagaacaaaggtttgagcacaaactggtcaaaaccaagccattacatgaataaaagatatagcaatagagcccaaaaagacaagccccctaacttaatacaactgatgtatgtagaaaccacatctgtaaggactagggagtaagaaccacataaaatttgaccaaacatttatatattaaaccacaaaagtttactctacctacctaaaaagtaaagcgcaaaagtttatgttgatacagaaagatacaatacaaatagggtattaataaacagtggatttctttttccttaggattgaataatattatccagtaaataaaattataaaactaaaaagagtgaaaggcatacactcactcacccaacagcctcatcccaagattcttgtacaaattgcaggagggacctttaatatagaaaccactataaatatcaagtgaatagtataacatgtttttaatctcgtggatgtgtgtaacaaaccaccaatcattttatgaaagaaatcgaaggacgaaataagaaattggcttcagttttttgttttgcacagagtagtgtttatatatgataggcgtatcatatttaccaaaatgtcaccaggttacacactagttttgagagtgcttatgcactcttcatgaaagaagtgctggtgtttatcaataagagaaatcattaaagcttattaccctaagtcagattagattcgaattattagtatttgaaaatattatagatgatgttgtgtaaagaaaattaataaatactatataaaaatctgcagccatcaaatacaaactcgactgtgtgcagttagaaagacgaacagtttaagaggggatattgaccatgtaactggaggcttctttacaaaggagttcaaaacgcctcttcttatttttcatttttttaaagtactatgggtgattcttttttgtttgtttttacctccgtaaatgaaaaataagtacgaaaacataaattttgcttatgaaggttgttgagaaacggggaaggtgtgacaggtttttcgaaaagaaaaaaggaaaaaaaaagttagacaattagtccaatgacaacacaacaggttatgaaagaagttgttttccttcctctatgatcaaatgggaaatacataaaaagttgtgtgtaattattgttacaccagaaacaccgatcaatattacatagtaacttacatttttaaactgagataatcaaatgcaaatctttggcttcttaccactttggatcaaacaagttccttatccctacttaaatggtttagctgtaacaccaacgttatagcatcaaatcagttcggtcaaagcaattcgagtggacaaaacaaaaggaaaaagtaggcaaactatatgaggaggtttattgtttgttcattctgctcctgcagttctgctaatggtcattctctgcatagttcatggacagtcgacagacacaccaattaccaatgctaatgtgacgaatagctcacatgtatcagcattgtatgtgttaggggattcctctgttgattgtggagacaacactctgttctaccctctgcttcatggtcgtctctctttgtatccatgtaacggctccaatgccacccttcttcctcaactacttggtacttttctttatgtttttcttcatcatttggactctgcattcgtgattcaagcaaattggacagaaccactgaaatctcacatgcaggatgcaggaagttataatttggaaccattgcattcgtgtcaggataaaataaatcttctttcagtgattcttataagtcctatcatggtgaatgaaagcatatttcctttcatttttttctgcataatgtgatctgaattaatgtattgcgatagctgcccatttattcgagcaatttattccataatcatgatctatagtgtcgtttaagtgacatcaagcacacacatgcatcatctctttctgtaagttcttcactggtaaattagaggggtaccaaaattatctgttatttctgccgaaacttttcaatattgacttacgatgagcataactaatgttagcacaggctcacacagatttaacactaattgatgtagtgggatcattgtgttgcagctgagaagattggattgacatcaatccggccattttatggacaaaatggatctctggaggaggttcttggtggcctcaactttggttcaacacaagctacaatcatgaaccagggaagctacagccaccagtctcttaaccaacaactacgccaagttgctgagactatgcagctgttgcaactgcagctgaatgaggacactgctctccaatttacaaaatcctccatcttttatctctccttcggcaaagaagattacattgagctattccttcattactcttccagttcgagtcgaatgttccagaacagttcccaatattttgctaccattttggtcaaccagatggcaaatgctgcgaggtatctctataatgcaaatgccaggaatatcatatgtttgggaattctgccttttgggatgcacacctcgtatggcctgggagttacacatcagctggagattataatgcaagtggatgtgtcgaacatgtcaatgacttggtctttgaatacaatagattgctggatgaacaaataggcaagcttaatacggaattttcggatgctcagatggtgttctgtgatgtttacaatggaatgatggagattatcaacgaaccaagggtttatcgtatgttttccctcccttgataacttcaaattgaaaatttacctatgctgaatgttgattgtcatgaagcatttgaaatctctttcgcctggcagaatctacaacaccaatctgttcctttatattgtaagaaatttacaggcactcatgtgaaacaactatatcaagtgttctttatacaggttttgaagacatgaagagtgcatgttgcagacttggtttgaatggtgccatgatagggtgtgtctccatggacatggcctgtgatcaagcttcaactcatgtttggtgggatttgttcaaccctactcaagcagtcaacaaaatcctagctgatgcagcctggtctggccaaccgatacctgatctttgccgtcctatcaccatccatgagttggttaacatggaagtctagcatttcctgtggctaccttcaatccttcatgatatcaaatttacactacttaaaactctcaaatatacaagtttcataaacaaaagtttcagaacaatttggggtaagcaaataattgaaaagccatatgccagtcccatgcagtacagaaagaggtaagaagtagggtgctactgcactggatcactgctaggtatgctttgaaaatcatttcttcattaaaatcgcacagcacaaaatgggttttggtgctgacagcatttgcttttgtcctctgaaatcgattaaaactatgcatttacaatattatataagaacttgaaaaagataccaaatgtacaactttactgaagaaaatgtaaaatattattactaaaacacatggagggaacaaagtagcaaaccctaaatcacagatattgatccaaaatcctaactcactctccatggctgtgaaaattcgaactagtttttgcttacctacattctccatcccaacctcaaaacccaaaaaaccctacttaaactcgttcactgtctcagcctccaaatccatctccgaccgaaagctccgggcggcagtgattggcagtgtccccgtcggatcctccttggtcgagaccctagcatccggcggcgtcgagatcttcctcttcgaacgcaaccgccgtccgttgcaaagcggtgaggcggcgccatccctctctgcatgcccgaagagttcgacatccctcaccacatcattgaccgccatgtgacgcgcatgcacatcttctccccttccgacatcgctgtctacttcggcaaaaccctaaaaccccacgagttcatcgccatgctccgccgcaaggtcctcaattccttcctccgctcccgcagcatgtcgccggcgctaccgaggtctccggcctcgacctccccgcagcgctggacgaccctacaccgtccactacaccgccaacggctcctggcgccactccctatccgtcgacgtcgtgatcggcgccgacggctccaatagccgcgtggccaaagccatcggcaccggcgactatgccgcgccatcgcgttctaggagtatttttatatttttatcccttttaaatataaatatttaaaactaattaattctaattaagatttgatttaacttttgatcttaaatcataaactatataaaacaaagatgtttttttttttttataaactatatttaaaaattattgtaatctttgttcatctcaattaatttttgaaatttaacatactattttaataaaaaggacgtgtcttgattcaaataatttatttatctcttcaatttattatttaataaaattgattagttattattaataatgataacatttattatttttatttatatataatataagtatgtattttttgcaaccattttttcttctttaagatcatatatgagtaaaaaaaataatgataacatcatacatgagtacacaaaattaatgataacagtgaaataagtagattagattggcaaactcatatcccaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttactacactaaaatttagaccttgcaaaagaaatttaatcaggaatttattattgatgaaaatatatccctccgatccatgaatatttggttgaaatttaatcatgaaaaaattatttattttaataaagtttcatttgttattattcacgaaaatatttaagaattgttctaaaataattatataaaattatttaataatattttttatcatactaaaatttagactttgcaaatgaaaattatacaagattgtatgattgatgaaaatatatccctccgatccatgaatattttcttgaaatttaatcatgaaaaaattatatattttaataaagtttcatttcttatgaaattcattaacgaaaatatttaagaattgttataaaataattatataaaattatttaataatattttttatcatactaaaatttagactttgcaaatgaaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagacaattttagtaaccttttaattatttgttatagttatgtttaataatcaatttacaacaactcttgtggtaattaatatgtttttgtattataattcgaattcttctattaaataatagtgtttttagatatggttatttttgagtaaatgattcaaatcccaagattatgaagaaaattatgaaattgtgaatccatggaataaacatattctcttaaagactaaataaaattatcatattttaaagaaaaaggatttgatttcaccaatatagtcacatgaatacgaatgcagcaataatgactgcttcacaccaacaacctccattgatgcactcattctcgttaaacaaccttcacgatgaggaagttgtccctccaattttcaaagcaaaaatgattgaagaatgaattttgggtttcattaatgcaataacaaagggaaaaatacaactacaatgatgaccacatatcaatcacctttgatgaaagtaacaaaatcaccttcattagggtgtgcaggagaagaggtgattttgtgcaggagccacaataattggatcttcttattccttttccctaatttcattcttttttatttgatttaaaaaatttcttctaatttttactttttattttgttaaaattgtttaataataaaataagattttttttaatccatgtcatgtgtgtttgatggggatcacccactgtagagtgacttgcttaacattttccttaaccaaaaacactataaataaagtaaaaaatataacatttagaggaaactataattaactttaacattgttacaagaatcaattagtagcaaaattagaaatatttaaactttttaatggttggcaatataaaaaattatctaaataacataaaattattttgataatgatttacaaatatattattatatcacaggcgaaggaagaaaaagcaaagaaagagttaaatcgaaatgaaaggctttgaagcagcgtaggctataaatagaagttcgtgaattgaaatggttgcatccaaaatactctctagttttgttgttgagttgaaaggatgaatatgaataagaatgtttggtgggttctactcccatactttctcttccttcttcttcttccttcttcttcttcctctttctgcaaccatgatgacagctctgccttgctacaactcaaatactcactcaacatttcagaattttggaacaacggaacagattgttgtgagtggcttggggtcgagtgcgacatcatctcaggccacgtgattggtcttgacctatcctataatcatttttttggtgacattccctccacaatctctcacttgtccaaattactgtcacttgatctcgccagctactacaatataagtgatggtcccaaccgcccgagaatgagaattgatccatacacatggaagaagctcattcaaaacgcaactaatttaagagagcttaatttagatggcgtggacatgtcttgtatcggagagagctctttgtcattgctaaccaatctctcttcctctttgatctcccttgatctccaagacaccaaattgcaagggaatctgtccagtgacatcctctgtttacccaatcttcaaggactatatttgagtgataataaagacctcggaggtgaacttccaaagtcaaactggagtactccactaagagacttggatctctctcatactgctttctcgggaaacatccccggttccattggccatttgaagtctcttcacacactagatctggggggttgcaattttgatggactgcttccctcatccgtctttaatctaactcaactcctcactttagatctatcatttaataaattagttggccccattccatattggtgttattctttgccttccttgtcattcttggatgttagcaacaaccacctcacggggtcaattgacttgagtggtcatctggactttcatcaattttcaatgttcaataatctagagcacctcgatttttctcacaatagttttctctctattcactttcatagtaccgctgattcaaagttcaaaaatctaaatcacctcgatctttctcacaatagttttctctctattattgttgatagtaccgctgactacatcttacccaaccttgaagtcttatatttatcttcctgtaatattaatactttccctaaattcttagcatcacttcaaaatctggtcgcactagatctttctcataacaacattcgtggaagcattcccccgtggtttcatgagaagctcttgcactcctggaatatacccaaccttgaattcttatatttatcttcctgtaatattaatactttccctaaattcttagcaccacttcaacatctgcgcgcactagatctttctcataacaacattcgtggaagcattcccccgtggtttcatgagaagttcttgcactcctggaatagcatgacggatattgacctcagtttcaacaagttgcaaggagatttcccaattccacccaatggcattcagagctttttagtctcaaataatgagctgactgggaacattccttcagcaatgtgcaatgcaagctccctctatgtactcaactgttagaaatttgggtatgataatcctggataacttcaaagaatcgtgttcgtacactttccgaacaaagtatttcgaccctattcttgcctgggttcacgaaatccttgttgggataattctttgaagaacaatctgcttctggcaatagagaacagatcaggaatgtagagagaaagtatgattttcgtatatctgaaatctgaggccaaatgactccttatataggagtttttccaaacaatgcaactctttgctactcgcaacctttccatcaaaggtagttatatgtgtatggttatgatgggaagttaacagcggttaacagcggttgagataagagtagttaactatagtaaatcacattactactaaaatccattgatgacactaaaatcaccaacaaatcccccccattttagtgtaatccttgatctactcagtataacgatcaaacaaatgcataaatgaaatgtcttgcgattgaatttcatcttagtacaaatacacattccatatactcaagaatcagggtatcgttacgattgaacccgtcaacctatttgaatatctgaagatattatacacatatgttttctacaacactctactattcatacttgacactttacaagccatgtgtccttatccattcgtaagcatataggaagccaaatccaaacttcttgaagcggcaaaacttcatgctcacataggtgatccttttaatcttgtacctgcatttacaatttttcaaaagaaccattaagaagatatacttcaacctaaccatcacttgcaggtctgagcaaataccttgggaagacaaacataattgctccaatttctaattataatctttccacattgaattctgcttctaacgttgtattagaagggaattgggtatatcataattagaatatttaaatggactttaatcccatccctattaccgacttctttactaagtctctagctaaccctttcgtcaagtgatcagctaagttttgttgcgaccgaacaaactcaatggatatcacccctttcatgattaattccctaatcatactatgtctaacacccaagtgtctagattttccattgtatatttgactataggctttagccaaggtggcagcactatcacaacggatagaaattggtgatatcggtttaggccatattggaatctcatataccaagtttcttagccattccacttccttaccagcagcagctaatgctacaaactcagattccattgtagaactagttatacatgtttgcttcttggaagcccatgaaatggcacctcccccaagcaaatacacccatccacttgtagaggacagaaccatcttccactggaacaaaagtcttgaaccagaaacgatccttgcaaacatgtgttgtggcgccagaatcaatccaccacgcgatagcatcatccttcgttttgggattggtccttagacccttttcccgaaccacttgcattcgcgttattgtgttttttcccataacggcaatccttcttgaagtgacctgttttaccacacttccaacattctagttttggtttcagtttggagccgaaatttcctttggcgttcttgaaagcacgcttctttcctttgtttatattgttattgttcttaccgccctcttcgatcatattaaccgagggtccagcaacttcttttccttttcccttgtcaccctccagcgcccttagagattcttctatgcgcaagtgacttccaagttgaaccagagacaagtcatcttttccatgcttcaaattgtgtttgaaatccttccatgaaggaggcaacttgtctatgatacttgagacagatattgtttcatccatcttcaatccatgttgtgtgaattgtccaaggattcggaggagttcattgaattgttccatgacagaccttgattcaaccatcttgtaattgttgaaatcagtcatcagaaactttttactggacgagtcctctgccatgtacttggattcgagacaatcccacaattcctttgcagattctacattttgataaatatcaaataagggatcagacataccgttaagaatgtgtcctctgcatatgtagtcgtcgttctcccactttgatctgcgccttatattttcaacggtatcttcctcaggaagttctgtaatcggagtagataagacgtacaccaccttcaatgttgtcaacatgaaatgcatcttcttctgccaacgcctgaagtcttgtccttgaaacttgtccaactttccgaaattagtagtcatgtccttgactgtgcttcctctaacgcttcctccatccatgattatcagaaaatactttgttcgtttgttagaaatttgggtatgataatcctggataacttcaaagaatcgtgttcgtacactttccgaacaaagtatttcgaccctattcttgcctgggttcacgaaatccttgttgggataattctttgaagaacaatctgcttctggcaatagagaacagatcaggaatgtagagagaaagtatgattttcgtatatctgaaatctgaggccaaatgactccttatataggagtttttccaaacaatgcaactctttgctgctcgcaacctttccatcaaaggtagttatatgtgtatggttatgatgggaagttaacaacggttaacagcggttgagataagagtagttaactatagtaaatcacattactactaaaatccattgatgacactaaaatcaccaacatcaacttggctcataacaacttgacaggccagattccgccatgcctgggaacattgccttctcttttcgcattggatttgcaaaagaacaacctttacggcaacatacctgggaacttttcttattacggaaataaattggagactataaagttgaatggcaaccaattggatggaccattaccacggtctttggcccactgcacatatctggaagttttggacctgacagacaataacatagaggatacatttccccattggctagaaagcctccagcagttacaggtactcagtttgcgatcaaataagtttcatggtgtcatcacttgtttcggtgccaagcatccatttcccagtttgagaatttttgatgtctcaaataacaattttagtgggcccttgccagcatcatacatcaagaactttcaaggaatggtgagtgtgaatgacaaccaaactggtttgacatatatgggtaacgccaatttctataatgattcagtagtggttgtaatgaaaggtcaatttgtggagctcaagaggatattaactattttcacaaccattgatttatcaaataatatatttgaaggagaacttccgaaagtcattggagaattgcattctctcatagggcttaacctttcgcacaatgcaatcactggtaccattccacgatcctttggtaatttaagaaatttggaatggttggacctctcgtggaaccagttgaaaggagagattcctgtggctttgatcaatttgaattttctggctgtgttgaacctttcacaaaaccagtttgagggtatgatacctacaggtggacagtttaacacatttggaaatgattcctatgctggaaatccaatgctatgtggaatccctttgtcaaaatcctgcaataagaatgaagattggccaccacattcaacatttcaccatgaagaatcaggatttggctggaaagctgtagcagtgggatatgcatgtgggttgctatttggaatgcttttgggatataatgttttcatgactgggaaaccacaatggctcgcgagacttgttgaaggtgtgcttaattaattaagagtgaaaaggacaaatcataggggaaggaaatagtttactcttagtttattatggatggttcttttgtgtgtctgtatgttttctgtaattttaacttctgtctgtggaagaaatatcgtctctggtgagtgagctatttcacgttgttccaaataagaaaaaaaaaatgtgatgaatgctttggtttcaatttcaagcaattaattttccgtaaattgacattatattaggaacatatatatacagttctctggaagaattttggctaacacaattaaatgtacaattgtatcattgtattttcagatatagttagttcatgatgaatgctgttcagcatcaaagctactgtgaaaagaagtagaaaaccaacctttcggtagttttagaattcactgccgatgaaggttctgtgggtcttctgtctttttctttactaacagcactacagaaaagtccattagtttaagttcggtatgtttttgcttagtgaaaggactttatgccaaaactccaaccagaaagagtaggattttcttatttgcaaaaacacaaggctatccttgaaacaaagtatttaatagtaaacgatggagaatttgcatacaagtggcttgagttaaaaccttctttcaactctctgttctacaaacagatattgaagttgacatgatcctgatacagcctctggaaagactgatccatatgcattacaaaatttctagacaaaggcaccagagggtaagcatgttcttgaaattaagggttgaggtaacattagaatcagataatgtacctcaattgttttttaaaattaaaataaataaataaacataatatcagagacaaatgttagtgataagaggatgagagggatacatatcacaggcataggccaagtaatggaacaaatctcaagaggttgcacattgattgattaaaatacagagaaggtatatggtgctcttatttatactatctattaagcgattaacatgtaattaaccataatgaattaagtgattaactaactcttaagtgaattttactactctcctaataacacacgtgggagacgataatcttttcatacctagcgagaagatatcaaaatgagtgatcatcccatattattggctcaaagactttgatggttatctccaaaagataaaaacttattagccacctcttgaatacagacatataccgtgtcacaaatgccatagtacgagctatgactaaaagtggacttttaaattaaaaattggtttcacctacccctgttattacatactttctgcaaacaacaatccctaaccaactcagtccaattattgattaattttgccgaatgatgatcgtagatgtgcccaggccactgtgtccctctgggaggttgcttaagcgaaaataaataaaccaaagtcaccataacaatgtgttaggaaaaactccacctcacacaacaaaattacccactcaccctagggatcttagatgattttttttttctcttggctctatatatagagttaaataacaatacaatattcaaatattattatcatcctaaacttaaaaaaattcctaaaataattaaatctagataaaatcttcaagatttgaaatataacaaatttctaaaaaaatctcctttaattttttcctgctccatttattttgaaatttaaattgttcttcaacaattcctccctcaattaaagtttctaaataactttttatttaaaatttctccaacttttctgtcctcacaacaccaaatgtctctccttgtagcttacatcccgaatttaaaccaacatacttatatccttgtcatgtcatctctcacaataaaattagaaggtacaactctctcacattttgaaaggtttctcctagccatattacatgctttctccaaacaactatccctatcaaactcagaccaattcttgattaattttgctgcatggtgatcgtagatgcgcccaagccaatgtgtcaccataacatcaaagtcaccataaccatggcctggtaatgttctaaaggctgccacgtttcatattttaaagttgaaaagatattgatagatatttggaacaaaaaaagaaacaatattgatcatactaatatgctcacagcagacgactgaattgatcttgaaattaaaaacatagtccttcttctgcaatttatataccctagcaatgtccaaatattgaaaacaattttatattttataccctgattgttggaaatcgacaatcacacacacaaaacgtaaaacagaaaagagaatagggaagagagatatgacacagtaatttaccctggttcacccaatgtaggctacgtccagcttgtctgtactataatcacctcaccgccactcgttacaagtcactcggtttacaaggggaatataaataggattaaaagaaaccctaacagtagctattcatgggccctagcccaaactactaacaaaagtaaaaatattacaaataatcagaggcccacaacagttggctttctgctgaccccgccaacaagaagggttgtcatctgactgcgaaggatgagccatatccaacactgatactatatatattcagattctattattcagttttgcatttaaaaaaaaaaatattggaaacctattaaaaatttatatcaaaagataaaataaataaaaagcaatactaacaatatactcttgtttaacattttttctattatttgctaaatttgatgtgaattctattacaaaatttgagtgatgggatttacgtaaaattcactcaatgattaaagatttgtcaaaaggactttctagcatttcacaactgccaaaaagttttacagactccattttggcgtcttaaatccatttgttaaacgtaattttttcctttaaaaaatggttcacgtgaaacgtgagtcacactctctccactttaattaaacattctcatcatctagattctggatgtgaatttcacacattattactgtaaattaaaacatctcaatctgtcatttttctttatctgtatttttatgtttaaacatcttaatagtttgtctcttttcatctactatattttatcattattttaaaattgaatttcaatagttcttataaaaataaattatcaatagttaaaactaatattatatcataatttaaattattcattataaatttaaaatataatttatatattaaaaaattgctgaaatactttttattaactgaattttcaaaattatttatttatgatggattttaatgatataagaataatttaatatgattctttcgtgtgcgatgcgacttgttttctgtaattttaacttttgtcttttgtggaagaaatctcacctgagtgatctatttcaagttgtttgcaaataagaagaaaaaaaatgtgatgaatgcttttgttttaatttcaagtaactaattttccgtaaattatctagggtaacctgcataagcatcaaggaaaatttgcacattgaaccttcaatcggcacacgtacagttggcgttatattaggaacatatgtactgtttgctggaagaatttaggctaacacaattaaatgtacaattgtatcattctattttcagatgtaattagttcatgatgaatgttgttcaggcatcaaagctactgagaaaagtagaaaaagaaaattgaaaatgaaagtaacataagaataaaaataattaaatttttatacaaggtacttagctccttaaggttactttctagctagcatcattccaaagtcttccttttcttttggctgcatcttatttctctgcttcagactcttgtgggttgctatttggaatgctctcgggctgtaatgtatcatttttcaaatttacactacctaaaactctcaaatatgcaggtttcataaacaaaagtttcagaacatttaggggtagcaaataattgtaaagccatatgctagctaggcctatgcatgcagtaatttttttataagagaaatagggtgctacggcactgcaacactgttgggtatgctttggaaatcatttctttattattagaacattaaactatgcatttacaatattaaataagaacttgaaaaaaaaatacccaatatatatacaactttactaaagaaaatgtaattattaatatattattactaagacacatggaaggaacaaagtagaaaaccctaaatcacagatattgatccaaaatcctaactctctccatggctgcgaaaattcaaactagtttttgtttacctacattctccattccaacctcaaaagcctgcttaaactcgttcaccatctcagcctccaaatccatctctggccgaaagctccgggcgacagtgattgatggtggcctcgctggatcctccgcagcagaggccctagcctccgacggcgtccagaccttcctcttcgaacgcaacccagcgtccgtcgtgaagccgtgcggcgcgccatccctctctgcatgctcgaagagtttgacattcctcaccacctcatcgaccgccacgtgacgttcatgcgcatcttctccccttccaacatcatcatcgacttctgcaaaaccctaaaaccccacaagttcatcgccatgctctgctgcgaggtcctcgatcgactccttcctccgctcccgcgcacatgctgcagagggttttctacgtagtaacgtgtccaggaaggctctggtggaactgtgtggggatgagtatgttcaacgcatgatgtttgagaactatttgtataagaagttggcacgtgggagagtgttggatgatgctaagcttttcgtcaataccattgggagcttggtgagatctaaaatgttggaaacaccaagcatggagagtttgatactatgactttggaaatcccactaagtgcatgtagcttctgcatcattttgacatggttttgctgcttgaacgttgatccaaaacgtctttccaaacatgttctaaataatttgtttctgtaatttctgtgtactgtattattatgtaaacttctaacagaggcacttttgaatttgatgcaatgatcgattgatcaccaattcaccaacacttactttaagaattgttttattcaaatacaaaagagcagtagtatacaatatttcattggttgatgtcataattcaagagcttaaataaagcaacaataaacttatacaagaatgagctcatcgatctgtacgtccaatcacacatcgaagacactgtccttcaatcaataaatcaaaagctttgttgatatccttgaactccacctcgtgtgtgacaaacccatccaaattcatgcagttcctgttgataattgcagatgaaatttagtaccaaacaaatgcatcctgaaaacttggaaattggtattatgtcagtgttatttaacataaaattggtattatgacaaacctccgctatagtttccagatgaaacagaacaactgctgctcatacatatgaaacatacaatgcaactaagaaagccattaaaaagtactgaaaaagataaaaaaaagctagaatagttatggcttacctttacatcatatgggttgtccttgagttgttgccaatttatgttccatggccttccaaaacacaagatgagtcaatgcaacgtgttagttatagtgtagagaggatttgggagctgatctatgaaatatactttgtgaaaacgacaaaccaagtacagacacttttgctccccctgaagctaaacaagctagaatattggtatcacttccttttttggtcactggtattctcaattctcatgtctcatctcagcctcacgcactgatcctttcccttttttggtattatttttatgagctgataaaaagatatttaaatgttactcattcagtcctgtaggtattaacacaacattttatgtttcagtcttatacctaagaattatttgttttagttattgcatgtatatgtttagtttttttttttaatctatgtcatctaaaataattctcactctcgtctcaaatatataaaaaaaatatatatatttttcttagtctcaaatataattttcttaaactaattttactttatttatattaatgttattatatctaaaatgtttttcacttaattgagattttaatttcaataactatttttaaattcctaacatcaagttctaaccaagaatacgttgaaaagaaaaattaatttttaattgagattggtgtaattaaatatagttgactaacttttttaataaatgtggatcaattttttttatatatttgagatcggagagagtatgggcaaaagaaaaatacaaattaaaaaattaatttgaaatctggggcagtttggaaacaaatttgaaaaatgagacactcaaacacgtccaatttatgtgtgtttaaacacatccaatttaggtgtgtttcacctaattgtgacacgtgtcattttgaggcgcagtgtccataaaacttcgaacagtcataacttttgactgtaatgtccgattgagacgaaaccggtgacaaaacgctcgaaattgagaggagaaggcaatgtccgattgaggcgaaaccggtggcaaaatgcttgaaattgagaggagaaagcctaggcaaattctcgaaggggattcggtcaactagtttttttcaaaaaacgcttctaagtgcttcaaaattaggatttaagattcaatcatccaaaaatttcctttttgtcttattttttaattatttaattagttaatttaatgttattttttatttttaattacttctctgaatttcgaacgttttgacatatcgtacgcctccatcgaatatttctatcaaaagttatgactatttgcaggacatatctacacctaatttgagctatgaccgtttgaataacatatcgtatacctaattttgactaatttttttgcaaacattaagatgtaaaaataaaaacatcaacttaaacaatcatgagtgaattaaaaattatatgcatatttaattatatacagtaatgaatttgaagagattaaattgaattttgactcaaatcttaaaaaaaaaaaattgaaccaaaatcaaaaactcaaaaagtgtatctagacacaaagacacaaattattttcatgaaaattaatgtttcgtaaaattaaaataaatatcatttttatggaattcaattaaaaatacaacaaagttaataaaaaaaattagtccaaattaagtaatttttttggtatatttatttaccaaaattatactgtaaatttttaaacgatttcagttaaaaaaattaaaaaatcataatattgtgatcgcaacacattttaaaaaaaatattttgtaaaaaagtattagtgactgaattagagactgaattagcgacggatttttaaaaaattccaatattatgtattaacggccgaattagcgacggaattagagacggatagagtcacgtccaaattgggtgtgtttgagtgctccatttctcaaatttgtttctaaaatgtcccagatttcaaattaaattattaatttgtattatttgttttttggcagagagtatgaacttataaaacattatgtgtaaagaataataaaagagttaaaaagtgaacgtgtaatgactaaaatgaacagtttttaggttcggagacacatcttgaatgtccagatatcttccacttctgagaggacattgaagaaattattttctcttatttgcaggaagccaatatgaagaatgttgaagacatagttgaaaacaaaatgccttgaactttctgtacaggttaatgtcataaagtgaaccaagataaaactactattttgtgttttttttttctggcaatattcattattattcaggaagaagggaaataaatcagtcagaccttatgcttacaaggcacccaaatatttgggagttccctgaattaccaaacaaaatgtgtcacaatgtaaatattataggtttataacctttaggcgtatgtggagtctaacggcccctcgcgccactccctattcttcaacgtcgtgatcggggccgacggctagccgcgtcagcgactacgccgcgccatcgcgttccaggagtctatttaaatttttatcccttttaaatacaaatatttaaaactaattaattttaatttaaatttgatttaaattttgattttaaatcataaactatataaaacaaagatgtttttttttataaactatatttaaaaattattgtaatctttgttcatctcaattaatttttgaaatttgacatactattttaataaaaatgacttttcttgattcaagtaatttattatttaataaaattgattatttattattaacaactataacatttattatttttatttatatataatacaagtatgtattttttcaaccattttttcttctttaggatcatacatgagtacacaaaattaatgataacaatgaaataagtaggttagattggccaactcatatcccaaagttaaacaaaatttttgtcttcaaacatttaaaaagagtgaaaatgcttcaaattccaaacaagaatttattaatcattctaattaaaggttaatatgatcagtaaaaatctaatcaacctcaacaaaagggatttagttaatataaaaaattgaggaggaaaaaaagaattatatagatacttaaagagacatgagttactacttattacatccagattcaaactcacactagttaatttgagaatcaaagtccttaattacagctaacatcctaattttgatatcaaggaaccaccatagaacagcatttagcatgatcacaaagttctcattcattatccttgaactggtgtggaatcttttgttatttatcttataaaattttgtaacgtcttgatgaagggaagactcgacaatagctagtcatagtatttattgtttattttaggaatattcttttactcaccttgtagaaggcaatctaaaaagttgtcaagcataatacttatcatttataattctttataaggagtgaaattctagtgtcttgactcttaatgaaaagcaaaactcaaaaagttgccaaatataatacttgtcatttctttaggatttttttacacgtctttgaccaggtcaagacttaaatttgaaataggaaaatgacaaggtaaatgaacaaaacaataacaaaaaagtagcagaaattaatttgatgatcgatttaattaaaactaatttaggcataaaatcatgggagaaaagtgaataagaaattttttaagagattgatttgacaactatttttaaaaaaaaaaataatacaatctactgtataatatggaaggatatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaaaaacaaaatttatgtggaaaatgacttaatatatttttggaaataattcaatttcaaaggaaagatatcataatgcaaatatatatgaaattaaattttgaaataatttaatttaaaattaatcaaattgtgaagtatcaattcaaataattaacattactatattttattttttccttccattccaatcacaatcaaaattaaatgacattttttaataacatttttttactgttaaaacatctttagatgatgtttgaaacttaaaaagataaattaaatgcaaaagaattctattgtaattaaaaaattccactcaatattttgttatccaaaatcaagagtgcaaatcataaaaaaaattaaatcaatttttttataaaataaatatcaaaagaaaatatgtaagacatcatcatagtaaataaaaattatctaatatgtaaaaatatatttaaatatttcttaaaatattactaacatatatttattaaaatttaaactaaattattaataatatattaaatattggttgttgtggtgaaagaacaggttacgtttctactccccaacacacacgaaggaacaaaaggttaaaggaaaacgcgtgacacaatttacgcgaaccaaaatttacgcggttagactgtcaattgttatcattattcatgacttaatgttcttgtaactttactactttagaatttaagttgtatattttatcactttaaaacgctgtttactttatcactatagcgtcttggtctatgtgatattgagtgctcgttgctttttaactttcttttgagctacttccgtttcaaagttgggcttttttttatcatctcggggttttttttttttttttaattttttactcaaatttcattctatatccttttctttttacaccctaaaaataatttcttagttgtttcactcacattatacctagatcccctccgttctaaatattatttaataatttaacagaaattagacaatattgatcacatgacttttaataaaattttatgtctaaaatatcatcatcttcttcctctcaacctgaaaatatttaagactcttgtttcttttttatatttgctgagacgtaaatccaactatttggtggatgtgaacccactacgcaatgttaacacattcttctcattctttgtcctactaacatacatatgaactgaattttgattctcaacaaacattttttagtacatcatgatcagtcttaaagagaataattttactactagcaatagaacaaaaccacaaaataaaagggtgacatggtgacaagtttaaatcattagcaatgttattcacacactcatgtgcgttgaacattctaaatttatcaggatcaacattgtatatttcacttggttcgttgcgttggtccttaaagtggatcaaaatattcatgttgtccggttcaggatccatgtattctagttcatccattgtgttcatgtggtcctaaacatcaatattattttaatcaacaataataaataaatgattttaaaaatcataagtggtctcaaactagtcccccattgaaacccctatcagaaataagcaacaataaacaatcaaaattaaataaataatcttaaaaagtaacctatatacaaggtccagtggtcacttacaagcataacccttgcatgaacagaaatcgtggaacaagaagagaaacagaaccctcgtgaacgtcgaagaggaagacaaatggaggcgcacataaacgtcccgaactggaacaggaacagtggagaactcacgaattgaaagtggaacaatggaaaatttacaaactggaagaggaatggtgaagaactcgcgaatggtaaagatgaatggaatgtgaatgtcatgaaagaaagaggaacttgcaccccatgaaagctgaagaagaaatccctataagagggagaagattatttgaattttacaattaaaatataagagcaattttgtctgctcacatatttcaattgacgttagttaataacgttaatagagggggtaaaagtaatatgcaaaaaatgaggggtatcggataaaatttaagcaaaacacatgaggtgcaagtgtaatttactcttttttttaattaccattttggataaattttaaattaattattaaaaaggggtaaatcataaccaatattacgactcctgattcaaaagtcttaaccaatgttataacttttaatttttttaactgaagttatcaacaatttatgacttcaatttaattatttttttaaaatttataactttaaagttgtatcaatttttttttttttacgttttaaactgaagtcgtaatattatttacaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaactattttacgactacaattaaaaaaatgttaaaagccataacattggttatgacttttgaattaaaagtcataacacatattatgactcatttcttttagtaattaatttgaaatttactcctaaattgtaattaaaaaaacacctctagatagtaaaaaaaaacctcaaaattgagcctacaatgacaagactatatagaaaaataataaataaataaataataatatcttagtttatgattggatataattaagagagtttaaaagtaccttaaatctcaaaaacaataatgacaattatacactaacaacctccatagtctctcactcatgttaaacaaccttcacaagaagtgcactgaggaagtttttcctacaatgttcaaagcaatagtgattgtgggacagattttgaatttcactaatgcaatgacaaagggacaaatacatatgcaatgatgtcagatcaatcacatccgatgaaaataataaaatcatcttcacaagtggtgtgaaggagaagtagtagttttgtgcatgagccagaatgtttgggtctttttttttcttttatctgttttcattcttttttatttgatttaaaaattttcttctgctttttttactttttattttattaaatttgtttaataataaaataattttttttaatccatgtcatacgtgtttgatggggatcacccgctgtatagcggtttgcttaacattttccttaaagaaaaacactataaatggagtaaaaaaatattacatttagaggaaactataattaattttaacattgttgcaataatcaattagtagaaaaattataaatatttatactttttaattgttggcaatataaaaaattatctaaataacagaaaattattttggtaatgatttacaaatatattattatattaatatcaattgagtaaaattaaacattcaataaatatttaaaaataatttgataaaattagaaatattattttcatgaatttcttacaaaactcatttgtgcgcctttaaaaattaagtgcgcctttataaaggaggacatgatataaacacagcagaaggaagaaaaagcaaagaaagagttgaatcgaaatgaaaggctttgaagcagcgtaggctataaatagaagtttgtgaattgaattggttctatccaaaaatactctatagttatgttgttgagttgaaaggatgaatatgaataacaatgtttggtggcttctacccccatactttatcttccttcttctttttcttccttcttcttcctcctctttctgcaaccaccttgacacctctgccttgctacaactcaaatactcactcaacacttcaaatcatttttcttccaaaacagaatcttggaaacacggaacagattgttgtgagtgggatggggtcacgtgcgacatcatctcaggccacgtgattgctcttgaccttagcagcagtaatcttgaaggtcaactccatcccaacagcaccatcttcagcctaagacaccttcaaggactcaacctagcctttaatcatttttatggctcttcaatatattctggaattggtgatctggtgaatctcatgcatctaaatttgtcatactctggattcactgctcacattccctccacaatctctcacttgtccaaattactgtcacttgatctcgctagcttccacttgataaatggtgatcccaactccccgagaatgagaattgatccatacacttggaagaaactcattcaaaacgcaaccaatttaagagagctttatttagatggcgtggacatgtcttgtatgggagagagctctttgtcattgctaaccaatctctcttcctctttgatctcccttagtcttacagacaccaaattgcaagggaatctatcgagtgatatcctctgtttacccaatcttcaacaactatatttcaatgaaaatgaaaacctcggaggtgaacttccaaagtcaaactggagtactccactaaggtacttggatctctctgttactgctttctcaggaaacattccctattccataggccatttgaagtctcttaaccgtctagatctatcccaatgcaatttttatggactggttccctcttcactgtttaatctaactcaactctcctttttacatttaagatcgaataaattagagggaccaattccaagcgaaatcaataaactttcaaaattgcagtttctagatttgtcagataacaagttaaatggaacaattccacgttggtgttattctttgccttccttgttaaagttggatcttagcgacaaccacctcacggggtcaattggtgaattctcatcttattctttgatatacttgtcactctctagtaaaaaactgcgaggtaattttccaaattcaatatttgaactccaaaatcttactgttttgtatttaccatcaactggcttgagtggtcatctggactttcatcaattttcaaagttaaaaaaactatctagcctcgatctttctcacaatagttttctctctattaactttgatagtaccgctgactacatcttacccaaccttcgatttttatatttattttcatgtaatattaatagtttccctaaattcttagcaccacttcaaaatctgctccatctagatctttctcataacaacattcgtggaagcattcccccgtggtttcatgagaagctcttgcactcctggaataacatttattttattgacctcagtttcaacaagttgcaaggagaccttccaattccacccaatggaattgggtactttttagtctcaaataatgagctgaccgggaacattccttcagcaatgtgcaatgcaagctccctcaatatactcaacttggctcataacagcttgataggccagattccacaatgcctgggaacatttccttctctttgggcattggatttgcaaaagaacaacctttacggcaacatacctgggaacttttctaagggaaatgcattgaagactataaagttgaatggcaaccaattggatggaccattaccaaggtctttggcccactgcacaaatctggaagttttggacctgacagacaataacatagaggatacatttccccattggctagaaagcctccaggagttacaggtactcagtttgcgatcaaataagtttcatggtgtcatcacttgtttcggtgccgagcattcatttcccaggctgagaatttttgatgtctcaaataacaattttagtgggcccttaccagcatcatacatcaagaactttcaaggaatgatgagtgtgaatgacagccaaactggtttgaaatatatgggtaaaaacaattactataatgattcagtagtggttgtaatgaaaggtcgatccatggagctcgagaggatattaactattttcacaaccatggatttatcaaaaaatatgtttgaaggagaaattccgaaagtacttggagaattgcattctctcaaagggcttaacctttcgcacaatgcaatcactggtaccataccacaatcctttggtaatttaagaaatttggaatggttggacctctcgtggaaccagttgaaaggagagattcctgtggctttgatcaatttgaattttctggctgtgttgaacctttcacaaaaccagtttgagggtatgatacctacaggtggacagtttaacacatttggaaatgattcctatgctggaaatccaatgctatgtggattccctttgtcaaaatcctgcaataaggatgaagattggccaccacattcaacatttcaccatgaagaatcaggatttggctggaaaactgtagcagtaggctatgcatgtgggttgctatttggaatgcttttgggatataatgttttcatgactgggaaaccacaatggcttgccagacttgttgaaggtgtgcatatttgaggagtgaaaagaacaaataacagaatccatgcaaattgacaaggaatgcattagtttaatatggttctgtattatatgtgtttgtatgtatgtatttatttacaaaaatgtcaccgcgttaatttctaagacggtatttgatcaattgactttaaatcaacatcataaaaaaggctttttttagtagtagtattttttattttttttgtaatttttatcttctttgtttctgtgatgaaatttcatctcttaatattatcaagtgatctatttcaagttgatgtgcaaataagtaaatttagagatcaatcaatttttgttttaagttccatttatttgccataaattgtctaattagtcgtatcctgcaaaggcattaggaaaattcacgtgtccaaccttaaatcatcacaaaatcagcattttagtaggaacaaacttggatagttttcttgacgaacttagattttcgcaattgaacattcaagagaatcagtgtatattagattttccaaacaagctagatttgtgttttattgtttactagaagccatactaattaccgcactggatataaaatgaaacaagaatccatactaattaccgcagtggatataaaatgaaacaagaattcaacaacatgctacactttcaattgagactattttaacagaagttggttagaatttttttggttgacatcaactaagatttttaacctactttgatcgagactatttttgttgacgtcaatgacccaagccggcattggtgaaaagatagcgttgatcgacatccctccaaaatagctttagttgatgtgaccaaaaaataatatcgactgacattgatcgaaaaatatcctagctgatgtcaaccgaaaataactctggccaatatcaacaaaaaccatgatcgatcagtgtcggccaaaaaacataattgattgatgttgacttaaaaacctaatcaacgtcaaccaaaaatagcccaactttcatcgactaaaaaaaacctagccaacgtaaacaaaaaaatagtcacaactgacgtagaccgaaaaaatcctaacctatgtcaacaaaaaataaccctacctgacctcgacagaaaatattactgaccggcattgattgaaataacctagccaaccttgacaaaaagatagttccacatcgataaaaatagtcgattgacgatggccaaaaaaaccctaacagaaattgacaaaaaacatttgtgaccgaagccgactacaagcaaccttagccaaaataggttgaaaaaaaatacccgatatacaactttactaaagaaaatgtaaaatattattactaaaacacatggaaggaacaaagtagaaaaccctaaatcacagatattgatccaaaatcctaacactccatggctgcgaaaattcaaaatagtttttgtttacctacattctccattccaacctcaaaaccctacttaaactcgttcaccgtcttagcctccaaatccatctctggacgaaagcttcgagcgacagtgattgatggtggcctcgctggatcctccgcagcaaaggccctagcctccaacggcgtcgagacttcctcttcgaacgtaacccaacatccgttgtgaagctgtgcggcgcgccatccctctctgcatgctctaagagtttgacattcctcaccacctcatcgaccgtcacgtgatgttcatgcgcatcttctccccttccagcatcatcgtcgacttcgaaaaaagcctaaaaccccacaagttcattgctatgctccactgcgaggtctcgactccttcctccgctcccgcacacatgttgtagagggttttctacgtagtaatgcgtccaggaaggctctagtggaactatgtggagatgagtatgttcgacgcatgacgtttgagagctatttgtataagaagttggcatgtgggggagtgttggatgatgctaagcttttcgtcaatactattgggagcttggtgaggtttaaagtgttggaaacaccatgcatgtagagtttgatactatgactttggaaatcccactaagtggatgtagcttctgggtcattttgacatggttttgctgcttgaacgttgatctagaacgtgtttccaaacatgttctaaatcatttgtttctgtaatttttgtgtactgtattattatgtaaccttctaatggaggcacttttgaatttgatggaatggtggattgatcaccaattcactaacacttctttaagaattgttttattcaaatacaaaagaatatatacaaaatttcattggttgatgtcataattcaagggattaagtaaagcaacaataaacttatacaagaatgagctcatttgaccatccaaatcacacatcgaagacactgtccttcaatcaataaatcaaaagctttgttgatatccttgaactccacctcatgtatgacaaacccatccaaattcagtttcctgttgataattgcagatgaaattcagtaccaaacaaatgcatgaaaacttggaaattggtattatgtcatgttatttaacataaaattggtattatgacaaactgccgctatagtttccagatgaaatagaacaacggctattcatacatatgaaacatacaatgcaactaagaagccattaaaaagtacagaaaaagaaaaaaacaagctagaatagtcatggcttgcctttacatcttagcatctttagtgatagatcttaaattgtgattttagatcactttttggtagatttcataatttcacgtaggattgaagatctctcaatatctctctcattttttcctttagtggtagatctcattttaatatcttagggagagaggaaaaaaattattcttttttttaacaatgtgcagatatttatgatttttttacaagaattcatttttcatgttagagatctcttcacctcctttattgagagatctagtggactcaagatctagcactaaaaatgcttataggttgtccttcagttgttgccaatttatgttccatggcgatccaaaacacaagatgagtcaatgcaacatgttagttatagtgtagagaggatttgggagctgatctatgaaatatccttagtgaaaacgacaaaccaagtacacaaacacttttgctacccatgaagctaaacatatttaaataaagcaacaatttaaatgttactcattcagtccttttttgttcactggtattctcaattctcatgtctcatctcagcctcacgcagctgattctctcccttttttgatattatttttatgagctgataaaaacatatttaaatgttactcattcagtcctgtaggtattaacacaacattttaggtttcagtcttatatacctaagaattatttgttttagttattgcatatatatgtttaatttttttttaatctctgtcatctaaaataatactcactcccgtctcaaatataaagaatatatctttttcttagtctcaaatataattttttaaaactaattttatcttatttaatgttattatatctaaaatatttttcatttagttgagaatttagtttcaataactatttttatattcctaacatcaagttccaatgaagaatacgttggaaagaaaaattagattttaattgagattggtgtaattaaacatggttaactaattcttttaataaatgtgactcaattttatatatatatatatatatatatatatatatatatatatatttgagacctgagagagagtatgaacttataaagcattatgtgtaaaggataataaaagagttaaaaagtgaacgtgtaatgactaaaatgaacagtttttaggttcagagacacatcttgaatgtccagatatcttccacttttgagaggacattgaagaaattattttctcttatttgcaggaagccaatatgaagtatgttgaagacatagttgaaaacatgcaaaatgccttgaactttctgtactggttaatgtcgtaaagtgaaccaagataaaactactattttgtgctttttttttctagcaatattcattattattcaggaagaagggaaataaatcagtcagaccttctgcttacaaggcacccaaatatttgggagttccctgaattaccaaacaaaaatgtgtcacaatgtaaatattatatgtttataaccttaggcgtatgtggaatccaccacactcgggtgccgatcgaatacatgtaatgtagtattatgtgatttcaccatataacggagacacatttgattaagcatccgcgtcaaggggaatggaagacatgtcattcatgattattataattatagcttaagcttgcttttacaatggaaattagccatcacagaaaatagataatagtaaaatactttgaagcattgttggtcaccatcaatttattactttgctgggcatcaactgcttttacatatgttttctccaaatacaaaaaaaaagagcatccaatattttacttattgatgtcataattcaagggcttaagtaaagcaacaataacttgtacaagaatgagctcatttgtccatccaaatcacacatcgaagacactgtccatcaatcaataaatcaaaagctttattgatatccttgaactccatctcatgtgtgacaaactcgtccaaattcagttcctgttgataacaattgcagatgaaatttactaaaaagaagcatccccagaacttggtattgctagtatgttatgtcattgttatttttacataatcattactaattactagttttacatatattaataaggggacaaagagcatagactaaaaaagactaagtaaaagaaattgcacatagtaccttgtccatgtagcgtttaaggagaatgggtacatgagacttgggtttgagtcctccaaataagcatcccctgagactcttcccactaacgaggacctcactacagctaaggttcaacttggattctggcttgtccactcccaaaactattgtttttccccaaccctgtaggcaaagtgttgcgcactcggcaagtgtaccggtcgtacaagtaataaagtgataagaaagtgtatcgttccctcgaggattgtggaccaattaaatcataaattgtatccttaggttggatgacaaaatgtaactaagagaaatgtgttgttgaaggaagtaaattaaaagctaaatgtaacataaacataaacataaagcattatatacaagataggtagtggttataccaaacgcaaccttaagtaactagggaacccacattcaacactcctagcattcttcatggattgatttcaacattcatctacactacctactcaatcatgcatcctcattcattaatagttaaaccctaattccttagtgacattaaccctttaaccctttttcataccctaattccttagtggtattttattaggttaagcattaagcgatgcactataagattgcaagcacccatccctattcctaggtgatattagcaagtcaccacacttagttccaagactaaagccccaatatccctattgtgaaccctagctctaagctctcaactaggttgatcaagtctagagaagagaaggaaacattcaagcaaagtgtaatgaaataacatagcattaatgaacattaaatacaacccaatccaagtggaagttacattaaatgcttgccttaaatacaaaaggaaactaaccaaacctagacaaggctggccttggtacaacaaaaagaagcataaatgaagagatgtaagcaaggagaggaagggaagagggaagaaccctcttcccctcacacccaagccctagaatcaactcccaagctttcttcttcctcctttggtgcatattttcgtgccaaaagtgcttagaactgaagtgggttcttgcatttatacttgggaaagtgaaatcccaagtttggcccttgacagcacaacagaactgcagatttaagatctggcgcggatagcgtgggacacggcgcgggtcgcgccaacttccagcaagaatgccatttccagggcagtactcgcgcggatggcgcgagtcttcacgcggatggcgccatctggagctcagatggcgctggtagcgcggtttgtggcgctaatcgcgccatgacttctcttgatcttctctgcatctctttttgcttatatttcctgccaaacacttcaattttgaccaaatatatcatttaaagcatgtgagtcacattcataccaattgggagcattttatcatataaaatgatgcattcaatggcttaattgagcttggaaacatcatgtgctaggcacatatcacaaagcattagttttaacaattcatgcattcaacaagtatggatcagttaagaaattacaatcaagcctacctcaaatttggagggaaacttcattttcatgaagtacaaggaagttgaattagttagcacaaaagaaaactagtaatacttttaagtgattttcaagctttgtgctagggtgatagtagaaaatcatgttgtagttattgttacaatataatcgcattattctgtcttcctataaaccatagtgcaaggcatgtttgtgcacacgttgataaagagagagagagagagagagagagagagagagagagagagagagagagagagagagagagagagagacctttctacaagaagcatatgcttcctgcatcaatgatgccataccaacacattcaaagcaataatctgctcccccaccagtcatctctaagataacctgcttcacaaccccaaatgagaagaaaatctaaggacttgaggcaattaattaaattaaataaattaagattggagcctagaagatggtagacctggctcacagatttattttcacattctccagaatggacaaagtctgagtccaaacttctttcctgaataaaagccaaggaacaaaccaaaataaccaattacataatctgagcacaataataacatggacaaaaatatatttaaacattactgcttaaggaaatgcttgatgtgatattattaaacaaaaaagcattaccgatttcatatctttctgggttgacatccactcctataatcttggttgctccacaaagtctagctccctcagcaacctatgataccaatggcttgcaatgtgcatttcaatataattaatcacaaaataccgaaagaaaacagagctaaacggacaccatactgctaatccaatactccccagcccaaaaatagctactgtagtccctggctccacacctgctgcttggagagcagcacctattcctaaaagtggaagtttaatcaatatattgaattcatgaatgttgttgagtagtgatttaaaatgtaaaaacaaccccttgtatttattataaccaaaatttatactacctccggtccttattataagaatttacactatcacttgtttcttataacaaggaccagaggtagtattatgtaacatatagttcttctctacattaatgtttgcatggtttaggcaaattacccgctgatataccacagccgatgaggcatgccctgttgggtggtattaccggatcagtcttgactagatgggcaatgtcgaccacagtgtactcgataaaactagaaacagacaagaaatggtgtatgatctctccttttaaatctgtgaatctagaagtggcatatctaggcatccagggagacacctcaaaaggaaactttgaacaaaggttgctcttgcttgatttgcaatctacacactccccacaatcaggtaagaaaattggaacaaccacatctccttttgtaacttcagttacatcctctcctacactttccacaaccctggatcacataaaaatggtctggaattcatcaccagttcctatagcatcaaattaaatgtctgaacaagtagatccaatggggcttaaggtggcaaatcattggcagccaacatgagataaaaggggcaaacatagagttgtagaatttcttaataaatcaatggccaaattattgtcattgaataatcaacaggccagggcttacagatatgcctttcccttaatcaaatccatgctcaaaattgaaatttgaaacactacgatttgtctcaacgaccatagttattcattcgtctccctaaaagctggatttaaaaaattaactactcttgagttggctcttcacaacttaagtgcatatgtaacacagaaaacacatgcagttaaacgaaaaaggtcaccaaaacttatgataggaaatgtttttctgaggcgtaaagaccacaataaatttttagtaaacataaatcaaagcaccaaagtttactctaccaaaaaaatgaaaaaaagaagaaaagtttatgttgatacaggaaaagcatacacatttagcataccatcaaggtagtggaatccttatgagaaaagagggtgcaaaataaaatgcataaactcaccctattgcctcatgacccagaattcttggataaatggcaggatggtccttcaaaatatagaaaatttatcttaaaaaaatcattaagaaatttccatagaaccaaaagaaaaagtaatctaaattctacagaaattgaatgaaaatgaaaaggtggtatagggaaggcattggctgagaaaaatgtcccaaatcacaataaatcatttagagggaccaaaaatggtggcaagtggcaacctgcatgttccgaaaactgatatcagtttgacagagagaggagcatataatacgaatgcgagcttcaccaggcattggtggtgccacaatgatctcctcaatactcagtggctcaccgggtttgcgacaaaccgccactacagtttacaaatgaaacagaacagatagagttcatacatatgaaacatgacatacaattaagaaagcaattaaaaattactacaaaaaaagaaaatggtagagcagagacaacattggtttgttttcaggaatgatggcacaccacacacctttacatcttatggattgtccttcagttgttgtggctactttgtgttccatggctatccaaaacacatgaggcaatgcaacgtgttagtgtaattgtatggaggatttgggagctgatcaatgaaatattaaatatactaagtgaaaactaacttgatgagggatatgactaaagttcagagaaagtgaatatagaaacgtcagatggggacttatgaaatagggacaattatatggtacaaaccaagcacaccgacatttttgcttcccttgaagctaccaaactagaatggtttcatttttgcgggtcactctcagcctcacctacctcatcttttacactaattgttagtctcattttgatgagttgataaaaaagaaataaatagttgtttgttgattatgagagtaaaatttttagatgcacccacaaatttcagaaaaaaggtcaggttttagttcgatgtttgtgttatcctttcttatctagtttttgaggaatcaatcttctactgtgacattactattattatacaaggttctaattttttttaataatttttatatattaatgttatatatttctattttaaagttgaaattttaaaaaataaacaattaggtcctgtttctgcattacagatgtgacaactggaaaattaaatgggaactttgaatttccaaaatagagaaagagacaggtattaactgtcattgtgcatgatttgtggtccatttttttttttaatctgagctcttatctactgttcttctataagatccggtgtaacatgattccaactctatcttcaatgctctaaacaaatcaaggttttattgatatttttgcctctgatctcactttacggtttcttttataaaaaatcataagctttagcacttacatatttcatatgaattaagttttgatttctactggtaatatcatcactaatgtgactgcaaatacaccagtacaagatacttctgacagtataaaattattaaaaatttctttcacagcagaaaaataagagaaattgtgatgtgttcaaacttattatattctcagttacttctgaaatgtcttgatatatagatagtttaacagattcaccgaaagaggctgatttttcattttttgcattattagcttatttaataattctgataagctattcatactctaggatgatgattgtattattaccaccttgatccagattcaactagtgcaatcattgacattgtttcaaataaaccatttgcgtatcaatatatgccagaggaaattgagaatgacataggtttaagtagattgtgatttcctttattttctattatggaagaaatttgtggctgttttgcattgttagaaaaactttatagtagtcttaatagcaacactgccaatcactttagtaatgatgttaaccacaaaacgaaacttatgtgtatgtaaatgattaaaatttaaattttttttatagaaaaaattataaagctggaacataggtagggagcaatatcaattaaaccataaagaaataataaagatataaatagaaaaatatattatttggatgaataaaataaaaatagtataaatgtataaagcaagcatgttaccgatgaaattgtggtggattgtcacttatggcctaagcttgtttttcaaatggaaattggataatattcaatgcatgattatttgtcacaaagaaatgggaactgctaaacgatgctgtttcagggaaacagatactataatacttttaagcattgatgatgatcatcaacctttttaacaattactttgttgggtatcaactgcttttacattgaattgaatatgttttcatcaaatacaaaattaagagcagtatccaacattttacttgttgatgtcataattcagttgctcaaagcaacaattactttacaagaatggactcatctgtccatccaaatcacacaccgaaggcactgtccttcaatcaataaatcaaaagctttgttgatatccttgaactccacctcatgcgtgacaaactcatccaagttcagttcctgttgataattgcagatgaaatttactaaaaagaagcatcccgaaaacttggtttatggcattattattttacataatcatcactatgttaatagaagggatcaagagcatagactgaaaaaaattaaaagaaattgcacaaagtaccttgtccaggtagcgtttaaggagaataggtacgtcagacttgggtttgagtcctccaaataagcaccccacgaggctcttcccactatggaggacctcattacaactaaggctcaacgtggatcctggcttgtccactcctaaaactattgtttttccccaaccctgtagggaaagcatcagttttaacaagattccacaagtttgcatctgataagagtttattattaaaatttgcaatcaaacctgtctcaatttgacaggaaacttcattttcatcaagtaccaggaatttcaaattagttagcacaaaagaaaaactattactagtgctacgtttagtgctaggttgatcctttaaaattattctgcagttattatttcaatcacattactctgtctgcctataaaccatagtgcaaggcatgtttaggggcactttgagagatagatagatagatagagggagagggatagagagagagagagagagagagaggagtgagacctttctacaagaagcatatgcttcttgcaccaatgatgccattccaacacattcaaagcaataatctgcccccccaccagtcatctctatgataacctgctaaacaagcacgtatgagaaggaaatttcaagacttaaggcaactaaattaaataaagattggagcctagaagagggtagacctggctcacagatttgttttcactttctccagcatggacaaagtcagtgagtccaaactttttacctgagtaaatcagaggaacaaacccacaaaatcaattacataatttgagcacaataatgacacaaaaatttatctaagcattatcattatagcagataatgcattaccagtttcatttttttctgggttgacatccacacctataatcctagttgctccacaaagtctagctccctcggcaacctaggaaaccattcacttgcaataagcgtttgagtataataaaccacaaaacacaaaagaaaaaaaaaactatgtggattccttactgctaatccaatacttcccaacccaaaaatggctactgtagaccctggctccacacctgctgttctccaagcagcacctacccctaaaagtgcaagtttaataaaaatactgaattagatgaacgttgttgagtagtgaactaaaatgtgaaaacaatcgtgtttatttatgatcagatattttgactataatttatagtacgcaactgatataattcttcaatattctttttctttaatgtttacaattttgcatggtttaggcaaattaccggttgatacaccacaactaagtaggcatgccctgttgggtggtattgctggatcaatcttggttagatgagcaatgtcaaccacggtatactcactaaaactagacacaaataagaaatggtgtatgatatctccttttaaatctgtgaatctagaagtggcatgtctaggcatccaaggagacacctcgaaaggaaactttgaacaaaggttgctcttgcttgatttgcagtctatacactccccacaatcaggtaagaaaattggaacaaccacatctccttttgtgacttcggttacatcctctcctatgctttccacaaccctggatcatatcaaaattagctagaacatcatcatcagcttctataatataacatgcagaagatataaaggggctcaaggtggcaaatcgttggcagccaacacaaaaataggtagcaaagataaatataattagtcgtggaatttgttcttaaatcaatgttcagattactgttgttaaaacatctgaaggtttgcagacacactttgctttgttatttaatccttgatcaaaattgaaacattaaaatttgcctcataactatccaatcttttctctaggattgaatttagaaaattaactactcctgatagttagaccacaaagatgcctctaaacaattttagcaggtgtaacacagaataccttttttttcttttgaaaggaaaaagtaatgtattgaataaaagagcaaaggtttgagcacaaactggtcaaaaccaagccattacatgtataaaagatatagcaatagagcccaaaaagacaagccccctaacttaatacaactgatgtatgtagaaaccacatctgtaaggactaggcagtaagaaccacataaagtttgaccaaacatttatatattaaaccacaaaagtttactctacctacctaaaaagtaaagcgcaaaagtttatgttgatacagaaagatacaatacaaacaggatattaataaacagtggatttctttttccttaggaatgaataatattatccagtaaataaaattatagaactaaaaagagtgaaaggaatacactcactcacccaacagcctcatgacccaagattcttggacaaattgcaggagggaccttcaaacacacacacacgcacaaaaaaaaatcttaaaaaattcattaagaagttccactaaggcttctaaaaaaagaaagatatctagatcaaaatagtgtgaaagtaaataaaaaatggtaaagggaagacattaactatgaaaaatgttttaaatcattcaaagagaaagaaaatgatggtaataacctccattttccaaaaagtaacatcgctgtgacaaagagaagtgcatataacacgaatccgagcttcacgaggcattggtggtgccacaatgatctcctcaatactcaatggagaacctggcttgcgacaaattgcagctacagtttgcaaataaagaagaacaagtagtaccatttattcatatgaaacataaatatcaacttcaaaaagctaaaaatctatttgaaataataaaaaaagagcatataaacttttttgtttttcatgaataatggcatggcacacctttacatcttctgggttgtccttcacttgttgttgctagtttatcttccatggcgattcaaagcaaagatggtgagtcaatgcaccaagttagaagtctaagtgcagcaaagagttgggagctgacctatgaaatacaagtgcaaatttgggtcaaaaagataaatgtgtaatgaattattattatatacaattatacaatattaatattaatggggtgcatgttgaaggaaatgacttataatatgagtgggtatagaatggtttgatggagacaaattaactaaggacagctacattttctcttccatgcatgtgaagctacctacctagtttggtattagcatgtttgcaggtcaccctcagctatttgtttgttaccatctaaatttagagagaaaaaatcagaaggttttaataatgcatatatgcatgtttgaaatatacgttttctcaatccaacaaacatcaatagcttttattgactagtttttggtttttaacataacatatatgacaaatttttatttatgatcatcacttgatgatgtttttctctccaaagtccaaaccaaaatttgcacctacccaccttggaattgcttttgcggtagatgaaacaatgtttaacctaatttatgtttagtatactaccctcctcccttttcggaattataggcattaattatatgaactttaaaatattcggaaaatattaattatatttctattactttttagatgaaaaaatttaaacataaattattttatttcaaactctatttttacaaaattaattttataagattaaaatcatttaaaattaaagttgatgaatgcacatctaaacacactaaattgtgaagcggccggtcgtcaatttaaaattgcgaaaatatacattcttgattaatttgacatttttgactttttagaaaatgttagcttcactcttatttattctgctttggtcgttttgtacatgacaacacagaatcacgtgtccggaagtgcgaagtatcttaattaactctgatcatatatgatcgagatgaatgaataaaccaaattcttgctacacaaagtttgaaggttccttgttagaacaatatcacgttgcaaactaacgagacagtattgcaaagattttgctttggcttttaactagtaaaaaacctattatgctttagtgccctcaacattttcttttttgttttatatatcgtcctattatgctttggaggctgtgattaagtattttgttagtcacaaactctttgtttgtttgtttttttgctgttttttttttcattccagatttctgatcagaaaaatagaagagtatgcttaatcgaacgtttgatgttctatttatttattgatagttttaaataaaagaagaagaggagcatgtttagtaccatacattgttttgttgcatgcttgataaaagttcgagaaaaaatggtcaacgaggaaagtagtaaatataatctaatcagatagacatgatttaaaagttgaaccaaatgttgagcattcatgagttattagtgcatttattgattgcaatttgctatttgtgattactatattttatttaataaataaataaaaattaatacaatccatgtttgaatttcattacaattatgaatatcacattgactatgtaactaataactatataaagatgacaattgaactccaaacatgataatataagtgtgaagtactattatagcactcatcttatctttctttctcttacacttattaatttagtaatcctttccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatgagtttagttgtacaacatgttaataaatcaaaaatcataatagaaatgtctcttaaggaggcttttaccggcattttttatatatatatttccaaacaaacactgaaaataactttaatttatgtttgtttcctgtacaaatatttgaaaataggaaagattaaatataaagtggcagttttataattaaaagtaaaaataactattatcaagcatgtagatcaagtgatataaaattgtttcggcatggtcaagaacaaaaataaataaaaatggaaaataagacacccttgagcttttaagtaagtttgtttaagcttattttttaaaataagtacttgttaataaaataagctgatttttatttttatgatgtatttgtttaaattgattttacttaaaataaacagttttctacttaaatttatatgtaatttatttttattatgtattttttacttaaatttaaacaaactcaccattaatatagtgagtaagaaaataaatatttgtaattaaatgtttatgtaatttaattctttggtataatcttatattaaaaataatatttttggtgtcgaacaagttcactataaataatagagatgacaatggagcgggacgggaacaagtttgatgtcccccactctcatccctgcttctaaaaatcgtaccttttcctttttcgatctccgttgggaataacattttacacctatctttgttcccatagggacgggtatcccgccctgtccccatccttagtccattgattttgttttttcaatttgcaacagttttttctaagagaatttcaaaaaagatattataaatggtgcacaagaagtgcatgtgattggtaaacaaaaaagcatacttcttgtgttagtattcaaggactacaatgcgtgcaagtgcgacacgaccttgcatgcaacctttcgagtttgcgacaatagtgtgtggttcgacaatcgacaccaacaatgcaaaatgaagggtgtgatcgacgtaaaacgaagagtatggcaaactagagttcaacggaataacaacacagcgacgcaacaaacactaccctcaaagatgcaagaccgcgacatgaccgttgacgtgagagatgattgtatgagagagacaagggttggcagccagcgacgctaatgagtagtgaatgagtgtgacgacgagtttgagagtttatacttttttattgagcaagtgtatattgtgtaaccctatgtaacaccccgtaggcctccggtgcgttatcattaataatatcaaaatcgtgctatcagtgttaacataaaagctgtgcggaagcgtaagaatcgattttcttgcatacattatgcatggaaataaaatcacaacacaagcatcataaatcaagcccctgttgatccaaaatcaaacacatacatcataggcagatacagatataaatcttaacaccaaaatcaggaggaagaaacatcatagactcatacataaaaacatactttttgtacatatacataacagaagctagaccacatctgggtcatacatcaaaatttgtacagaataatgggtgtacacacacaccctatccctacacaaggtacaagatagagatcaacacaaaactattctgatctttaactgcagccctcaaccacctcagcactccactagggcctcctgcccagaggtcgctcctctcccctagaagaagcacatgaaaaccacaaccctacacagggtgagacatacgtctcagtaaactcagggttctgggagatccgcccttatcctggttcacctccaagcacacacacaaaaccataaacacaaccatagcctaggacatcatcctagctctcttcacccggctgccgggtatatcactggatgctatcagcatcagaggcattccacctcatactggctctcacatccatctaaacataatctcacagagccaatacagaatcatggcgtaacaaccaatcactggctctcacagtcgtctcccagaggtactaaagcataagtgtcaaccactggacactttctataccagagaggcattgcctcataaactgtatagcatattgcctgaggcacccctcaggacttcactcaaacagatatggctcatctaagaggctctaggcccttatcccctcgggttgccctctcttagggatacaacatatctgtacacagtcaggcctgggcaagaacatccatgtagggcaaatcacctccaggaccttcacatacatatgcctgaaagagatcatctcataccagaggcactcatctttcaggacttccagatctactgcctgagagagatcatctcacacaggaggcactcaatcccttaggatttccaatcacggtctgagagagatcatctcacaccggaggcactccatccctcagactatcaatccactacctgagagagatcatctcacaaaggaggcactcatccctcagggcttccaaatcacatgcctgaaagagatcatctcatacaggaggcactcatctttcaggacttctaacccgctgcctgagagagatcattccacaccgggggcactcaatccctcaggactttcaaccacatgcctgagagaaatcatctcacaccggaggcactcaatccctcaggacttccagaaactggcctaaggataaccactcagggctttcatcatcactgcctaaggaggaacatccatacggggcaatccgtccttaggactttaggtggagagcagtggcacctcccaaggagtatcagccattcccagggagtcctcaaactcttcctctggctaggaaatctcatctagccggatactattccagtatcctcttgatgcaaacacagaccataccatggtctttttcctcagattcaatcatagaacactaacatagtgttcatccatcaaaaaggcccaaggcccatcacagctgtaccacagatgtatcattaccctcacactctctcagtgtctatcctggggtttaatctcatacataagcacattaacacccttccggtgtttaactaatcataatcaaccataggccacattgaccttgaacatgcaacatatatatatatatatatatatatatatatacacatccatggcataattaataccccatcacccacttgggtggcaaacaagcgtaagggaacatatcccagaacgatgagcttacctggcaaaccgtgcctgcagctccaaccttcatcaatggtctgcgtccttgacaatcacagtgtcagccctatcaaggcatacaagcacgtatcacagcccattcaagaacctaacatacataagctcatctgacttaaggttcatcaggctcatctaccacaagcctttccatggacccttcgaggtctatatcagatcaaccatggcctcagagtcattcagactcaatccaagccattcacaatgagctcaaagctctcacaccctaactactcagggatttccatagggtttggacggttcaacccccaagacaccgtcaccaaggcctctcaggcacctcaagcccatcaacaaggctcttgcatgtatcaatatcaagtgactcaatccaagtcacacatgcaccacctagagccaaaaccaacattcaccaaatcacaaactgaaagctaatccttcctcctctcatcactctaaacacatctctcaacttgacccagagctaattctagctctaccaagagtgggtcactattcatcaaaatccccaattcacaaaacaaccaaagaatctcgagtttcttacctcaatgacgacacagcaggcctctgggacactcctccaagcttgggtgtctgtgggtagctgtcgttcctcgccaagctcgagttttcttcacttctcttgagaatggggtttctcagaacaagggatttttggtgaaatggaggaaggattcaagctctctcaaggtttctaggaggtttgataggtttaggaagtgtttttggtgaagaaacaaggtcatggaagcttggggagctctcccatggcagacagggcactgaggaagaagaagagaaggttttctcttctgaaaacgcgatttccccttttatactgggtctgccagaggtttggcgctgaccgcgccagcttcaccgaccttgtggcgccaaccgcgccacacccgcgccatcagcgccaacttcccgaacctgtggcgccacccgcgccacacctggcgctggccgcgtggaaaaccagagggaattggttttccaggccacttcccgcgccatccgcgccatccatggcgctaaccgcgcggcctgggaatcatctggcgctcccagcgccatcctggcgctcctagcgccacattccagtgagtctggcgccaccagcgccatccctggcgctatcagcgccacacccttctcagggttttctcagcaagtcttctggcgccatccccgcagtaccccacgccatccgcgccagaagtctgggtcttacacctaagtaatagtaaaaaagtaatttaataaccacagtaggcgccgaggatggaaacaggaatatatgattacccatcctcattcatgtacataaataaatcacacgaataatactcgaacaacatgttcatatccaatcaaatcgagtattttttgtctaagatggggtgacatatgacaaatatatgcgagttcggatttctttgtcatccctgataaataatttagaattaaataattatgtgatatatatgctatttagtaagtatttattcataaataatttgtttttctaaataattcacaatataatatatatatatatatatatatatatatatatatatatataaaataacttttcccactctttttctgcgctttattcagattttggttcttctggtcctaatccgaaacagaaacaggggattcgcagttgtggagtagatctgagttgtgagcaatagattctccaaattttgcgggcaatgggtgggttcaccgctgaagatctgtcgaccatcggcggaatcgccaccgtgtcgcttctccattccttcattcccactcactggcttcctttctccattgtcggtcgcgctcagaaatggactctctccaccactctcatnnnnnnnnnntttagaattaaataattatgtgatatatatgctatttagtaagtatttattcataaataatttgtttttctaaataattcacaatataatatatatatatatatatatatatatatatatatatataaaataacttttcccactctttttctgcgctttattcagattttggttcttctggtcctaatccgaaacagaaacaggggattcgcagttgtggagtagatctgagttgtgagcaatagattctccaaattttgcgggcaatgggtgggttcaccgctgaagatctgtcgaccatcggcggaatcgccaccgtgtcgcttctccattccttcattcccactcactggcttcctttctccattgtcggtcgcgctcagaaatggactctctccaccactctcattgtcagtacgttacgttcctctctctctctctctctaattgcgcaacttaggtcagcaacggttttttttcttcttttgttatgtttcttgctctgtgatgcgcgaatcttgtcagggtttagggattgtgcttttcttctgtttgggtgtgagtgagcagtgaaaggatattaaattttctcacaaatgaatgacttgagttctgtttaaagatgaaatctagtgatgcggttatgaatttttccatatcctcttgcaacctctcttctcgaataaatctatattatacttttgaaaacgttaggttcagaatcgttatatgaaatgaaactctacaaatttaaatcatttgatatttgacttacatgcttaaaagcactccaattatgctcacattctggcaaactacaagccaagctcaataattgcaagtttttgcaatgatttgttgtcctccgcgactcaactgtagtgcaaaagttaattgcattagtatttgcatgaattgttatgtaattaacttttaaaataggtttaaatacatttttcatcatgcaatttagcgtttttttcattttcgtcactgcaaaaaaaaatgttttattccttgcaaactgtgtttgttttgtttttcgcccttaaagtgatttatataacacattttttaatgttcaaagcgctatataaaacgctttaagaacgaaaaataaaacaaacacattttacaagaactaaaacaatttttttttttgtaaggatgaaaatgaaaaaagtgttagattgcagggacgaaaaatgtatttaagcctttaaaatattaactttcacttattaggagccattctagtcttttgccttgttgctactttcgatccagctttctcatatattgacagctcattttaaaatatgatttattcattttaactaaacttctcagtgcttttatcacttcatgatcagctattcttggctagctataaagaacttaggatttagaaaatgacttgttggatgcaatgtatgttgaagttgacactctcatcttcaatcaatgattgcgaaaatttctttgtacgtccttgttgccattgaaagcactctgaatttccttcttagccctatccactgtttcatatatgtatccatcccattgcatctgcctttattcccatatgatgtctagcgcaaagactcagaagactgtgttcttggattttgtccataaagttttttaaccttattcattttatttcatgtagctgcacttggagcaattttgcatgtaatatccacttcactgcttggtataacggcaattaccatggcaaacaccattgctggtgaagaaacagtgcataaggttgcttcacttttgcttgtatttctgggtggtagttatataattctgtttctgatgggaaagggtggccatagtcattcacacaaccaacccatggagaaaatggctgtagctggacttattctcgttcctgcattgtctccttgtgctacaacactcccggtctttcttgcagttggaaattcctcttccatgatggtgcttgccatcatagtactactattcaggtattaatcaatggcctatgattatttaaagtgacatgttatttgttggaaaacggtgtcagtgattatcaatattaaaaattctgatgttgaccttaacattgaataaagcaaaagctcccaagaaatcctatacttcatgatcatgaaaatttgttttgattattgagaaactaatcaaatacattctattcaatgttgttaaaagtggaccaaagagtgaaactaggtagggaatagggagattccataacttttctgaagttgtttgaccatctactcagttttgagagtgaattataatcagacaagtgacgaattcatggttagaccagttggccaggtagtatgagttttaagttgtaaatcacatgaaacaatatcaaatttataaaacctttcaggaaatgtgattacagattaaaccaggttgagtattttagttggtccaaaggtgtttgaccctcaattatgttttgagactgaattataattggacaagtgtccaattaaaggttaaactggttggactgcctagtctggtttctgtcaacaattactctatcacttgaacattttcctacagggtatggaaatacatggaatattaagttgttttaacatgacatcatgtataccttttttcatgacaacttatgctaaggcttctaataagacatcatgtctgacaaacctctctttggtaccacaaactacttgaattttgagatgccatccaagctgaaaaaagatggttaacaattcagctagatcccttgactacttttttgaaattcaggttggttgatggaacatataggaatccttatttctgtcttgtatttgaattttgaatgctgttctgcactaaaagattcacaatctttaaggccgagtttcttaatctggtttgatgctactctggtatagatgccaattaagtttgcaaataaaaattgtttagatattcattactaaccaagcttacacatattgcatttacagcacaataactgtgatgacttcgctagtagcattgtcattttatggggccagtcagctgaagtttcactgggtggagcgatatgacaagcttcttgttggatcagtgctgtgtttagtaggagtcttgaccctactttttcatgatcatgatcatgaagtagtttcgattggacagcactcacattcacataggaagattatttccatgtgagatatataaatgtttttgtaattacatgcttatgagcattatcacggtattgtttttattttgtatcagaagggaaaaagaaaaaagaaaaaagaaaaacaaatgttgctgcttaggagaactgatcatcttggtctagttaaagtggttgtatactgagttttcaatgtgaaattaatgtgtttttggtgtaaaaaaaatactttgattaaaaattaaaaatgaatcaccaacaaattattctatatcttgaccttttctttagaaatttaattgggatgatttttttccaaaaactttggtgtttttgaaaatttaaaagttgatatgataaattgagacgagcaattaattttaatttaaattgttttgaaaagagtagctagctattagtgtcctgtttcttttatgtattatatatcattcctaattgttagcttctcaatgactttaacattataacactttacatagttgtatttcattcaatttcttgttggtaagaatttttcatcacttaaaatcttatataatatgtttctcggaaatttttttagaatgttacatattgcataattattttaagtcaagtacgtttgattgtagagattttgagtgataagttataaaatatatgtatatttttatataagtaatactaattaatttttttaaatcattattaacggtatagcttcataccttactgtctttgaatttttttcattctcgttgtggtttgacatatacatgaatgtgtgagggtatgcaaaagagaaagaataattagatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattatgtggcaaaatcttctttaaaatttagtgtaataaagtatttgattttttatttatataagtaaataaatggtctaccgaaaaaatattgtatgattttaatgtttgtaatagagttgaactctaatatttgtacaccaataaacgattcataataacgtaaaactttttgccaccattaaatgagattaaaacttctgcacaaatgaatcttatttatttcatcatataatgcatgttacgttttgcttgataatgaaacaaaaagacgctaaaatattggtcaagactattacaatgacaataataatacatctatagttaaatatattaaatggtgcgttaattaaagatgatttataattagatttaataatattattaaattaattatacgtactgattaattttactaaatttaatgtattttttaaatgtgtgacttgttatatgagtctatgatcattacaatacattattaataattattatagaattacataccaatatatttgtgtgtatacatattttgttcaatattattaatttatgtatttactaaatatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtattgattgtgacacaattcataaatgagagcaacaccaaaaacaaataaaaatttacatttatgtttttctatataataataataatactaataataataataataataataataataatagagtgatttagtattactataggtatgatttaatttaatttaagtaattattaattacataaataataatttgtaaattgattcatgtagagattttttatgctttcaaaatcattctacatatattaataaaaaaaaaaccatattctgcatatgatttttaaaataattattaaagtttaaaattttttaattatatcacattatgattgaatcatcctctctcacacacataatatatattacactgattgaatcaaacatatatatatatatatatatatatgtgtgtgtgtgtgaattgaatcaaaattagagattttctttaatagggagactaaactcccgaaaaaaaaaatagatggaaaaaattcgtgaataagaaattaattaaagagataaaaattacaatttttaataaatagtatctaagagtacaaattttttctaatattaccagcatgacagtgttctcaaagtgttggccagagtttcttcgttcaatgacaccctccctctgaaggttttgtgaagatcaacacagatgacaactccagttttggattcattccccaataacattgcggccaatggattaaaggtttttgtggtatatataatatatgccttgttgtacaactaacttgtatgatcaattgtgttatggtaatttttcttggcccaaaccgaggacccaatggaacggaatcaactcaaacttttcatctatcctaaccacccgacaacaaagatatgagatattccgttatccggatatctcggcctcgaagataagatatcggccagaagatcacgggcctcaaccaaccaaggtccagatatatggaatgggtcaaataaagggaagcccaataagactcagtcaatccactatgctgaatgtcatacgtggttttaatcgtcccagacggagaacgtagaagcacctactagccgagaatctcggacaaggtcgtgggattggatcgtgggcaaaccttcattcaactaattctcaggtgatttactataaatacaagcaattcaaggagaaaatgtacacacaattctgactctctctttcatttacacatagcacacactgcacaccacttatgtagcgtattccttatgtgatattcttctttgaggtgcttcagcctcataagtatcttcatagagagagagcctgatcccatagtaatttcccaacaatcattattggacattctgttctcatcgagcagaataaattgtatggatttgcatgaatttcaccctcatcatgccctaattatctgctgcattcatgatttggcagccaaggactggaacattactttcaactttcaagcaaacctatagagaagtcaatcaatgtgctgcttcttcctcaactctttgccaagtttgggagacttatcagcctcagttaattagctttttcttctcttgctgctgctctaggcatctgatttgttatatagttgttttgttcttcttgctgtctttatttttattcactgatgaaataattaatttgatttaaaattctcttttttactatttattacatacttaaagaagtttaaattatctgaaatttaatatgtaagatttttaagataatatcacattatccagttgctaaattaattaatttacatatttataaaaattagttttttttataaaataacttgaaaatgataaaagatgaacacatcattgttttttatttataattatccatttatttattttctaaaatttattcatttctcactataattatgatttattatgagagtcaattataattttcatataaaagttttagcattaatgtaactataatagtagttttttattatttaaagtatgtattgttgggttgatgaatttttttcatgtaaaaaaaaagttgttatatttttttttacacattatcacttttagttttagttatcggtaaagaatatgctgacactatgcttgaagaatatggtgacatttactgtggtccaccatatttaaaagacgaatttagaattagcgatgtagaaaaagtaaatcatcaattaaaggcatgacctaaaaaggtcatcaagccaagaaactaatcacatgtccacattttctacactacacttttgtttttcttctcatgtgatgatgttccactttaccaccctaagcccagcttacctttttgcaaatgtttaatatcttataacttaatatatatgatatcattttaatattattcaattatagtatttttttttcttctaaattacacatttaatttttttatagctttatatatatgaaaatagcgtatgcacttttttcaaggtacgtaaaatagtatatgaaccagaagtgtaagaaatctttgtattataatttaatcacacacatggacttcgatgcttaaataattcaactataagatataagtgattgggatagaatgtctaatgatcttaacgtgtaactcatctttgatagttagattaagaaaaaataaatatgaagatattaaaattactcttgagtaattcttttcaaataatttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcttacatcacttagaaataatagtaatgataatttataatcatcctccactttaattcattgagatgttttttaaatataaaaatgtaaaattgaatattaaactttaatgtactcactttctttttttagaagaataactcaacttaaagagaggtcacgaatagttgtttatgtaacaaactacattaaatttatgacttttgttattttgatttgtaatattatttttgtatttctattctttaatccttatatttgtgtgtgagagagaagtttttctctgcataacttactttattgagaatattaaacttcatcgaacacatttataagttttttgagattattaaccttcaactaacacatttttaactttgtttgtaattaaagctttgtatgtttttgttcaatcttttaaaaacgaataaataaataaacctgtatcagtttagacactctaacacacacactaactatacttttatactaacagatatgtataatagaatattattgaacttcaaccaatccacgtgtaacttcatttttaattcaagcttcgcaattttttatctcttcaatcttttaaacgaataaataaataaatgaacctgtaggaatttagacacttttttagatggaaaatgaaggatggaaaattagatgcctttgaaaagaaagctagtacaatttgctttcttgtgcattggtatattgaatattccaagcgcgtatttctcacacgctcaactttcgcagacactgggacccacgtggaggtgggcatcactgattcactgctgtgtttcttttgcatggaaccagctatgagtgaaaccattgcattattttctctctcttctctgaacattcccaaatcccatttctgtcaatgattctcttacatgggtcttcgctgaaatccaagttcatattttgcagctttagtacctgccaaattttccatctttttccaaattccaattttctttattagcggttcactgtgatctttgctttttgggttccccatttgttcctgctacataaactgttttttgggtttgatcccacttcttttttttttttggctaattactcaataaatatcctactttctattttggagctgggctatctatcccttccttgaaatttgtctcctttgtggtaaatttcattgctttctgcatctccacgcactcactcaatgtgtttctcattgggttttgaacattgtcttttggatttcaacttcaactttctttttggatagtggatgcttttgttctctttgattgttttcgagtttgagctggttttcccacttcaattgttggtgctgtttgcagtggtttcaataacattgttttcctcaccatatttctcagatcagatgcaatttttgtttgcttgtgtttccagatgaaagttgatggtgacattccaccagttctttagatgtcagtccattttcttaatgtgttacaaatacaatcatgtttctgtgtacctaaaaaagatactagtgatctgcattttttcttgtggcaattgttgctaagtttgttatgttaattcatttattgttcatttaatacatttggtgtttgatgaatttacagttagaacttcagtgaaggatttccataaagggaaagccaatttgagccagatttggaacaatgggggcctcaagctccaaaatggaggatgataaggcactactgcagctatgtcgcgaaaggaagaagtttgtgaggcaagcacttgatgggcgttgctcattagcagctgctcatgtttcatacattcaatcactgaaaaatacaggaacagctctgagaaagtttacagaacctgaaggaccaattgagccttctttgtacactaatgcaacaccagaacaaccacttgctttaactgaaaggaccctctcattctcttcagcatctgtgtcacatcacatagatgcagctgaacgtgaaaatttctctccaactccctcccctcctagttcttctagcaagttcagagcaaatcatatgaaacatagcactatttcttccaagaaagttgaggaaaaaccacctgtacctgttataggaatagtaacatcatcaggtactactacacagaataccagtgtaatctctggaacagcagcatttgaagattcttctcttccagctggaactccacagtgggatttctttggtctctttcaccccattgaccatcaattttcttttcaagatgggaagggtatgcatcaagatatagggcatgctgatgacatacaaagactaagggaggaggagggaattcctgagttggaagacgaagaagagaaggcttcatctcatggaagggaacactctagggactctgaagatgaatttgatgaagagcctgctacagaaactctagtccaaagatttgaaaatctaaatagatctaacagtcattttcaagccaatgttgaacctgccacaactaagcctctcagagggcattcagcttctgaagttgaattagtgaatggagaaaaggggacatctgcttatttatctccattaaagacagcacctatgccagctttgcctccacctgaaacaaataaaccaacggagaaggaaagtcgtaatgaaaataaagtcacccctaagaatttcttttcaagcgtgagagatattgaattgctctttattaaagcttcagaatctggccaagaggttccaaagatgcttgaagcaaacaaagttcactttcgtccaatattccaaggaaaagaaagtaatctttctggctctcttcttttcttttcatctggctttgaaacagttatcatctgggaatattaaatattagtaggtctaatgatgagattttgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgctacttaagatacattacagacactcccagcatggatatccattaaattgcattatggtaaattttgttgatatccttggggtttgaaagaaaaattcactttctgtttcaaagaagcttttggaagtttcttttcattgctgtgaaattaatttcaaaataaaatgctttaaaattttaaccagagaatttttatttgtaacagatggttctctggtgtcctcgtttttgaaggtatgtttctcatgtggggaggacccaagccaagttccagaaggtaatttgagtcatttcaactgtttatctttcatttttcccagacatttctgaccttgttgggttgaaccaatcttcttgttagttctgaaaatgaaagtactctctaagtgtacacattttccctcagtaggactgtaggagtgatgcgaattgcaaatcctattattaaatatgactacagctagtgttgatcaagaaattgttgaatgtttgggattctgtggtgcagagaatctggagaatttgtttacttgagaagatgtatttggtgttatttgtttcctacttagtttaaaattcattttgagttactgcaacagagtaataagcattctcttgtctgcctttaaaagtgaaactcatttcagaagataagattaatattagaccatctgagtaaatttcccgtctaattttttggtaatttagatatccatgcctgtgtttcggctgttttttgaattcaacgttaactattcaattcatcttcttagaacctgctcaaaactcggataagtacttaacttggcataggacggtgtcatctcgatcctcctcatcccgaaaccctttaggagcaaactcaattgacaatgctgaggaccatgcaaataatctctttgataattcttgtatgatctccggaagtcatgcatcaaccttggataggctatatgcttgggaaaggaaactctatgatgaagtgaaggtacgatgtatttcttatcaacatatttgtcaacctgtattttctgtatgttactttttgataataaaatgttgcacaactcttgtattggattcggatcttagactaaaccctgaagttttatgtttacaattatatttttttaataaattggtacatgtaatagaatatggctatttctctgtctgtttgctaatatcattgttcacttctgcgagtaggctagtgagattgtcagaaaggaatatgacatgaagtgtaaattcttaaggcaactggaatcaaaaggagaaaaggcctctacagttgataaaactcgtgctaaagtcaaggatctgcactcaagaatcagagttgcaattcataggataaactctatatcaaagaggattgcggagatacgagacaaagagcttcaaccacaacttgaggagttgattgaagggtatgctcctgtcagttttgctatttttatgaagtatctatttcatgccaatgtgtactgccttgataataatacatatacaagcatgggataaaaggtgcatcaagaagtgcgcaatcaggaaattccataagaagaaagtttatttatcaggaagtttatttttggtacaacttgctaaaattgattaagttctttatttggtaaaagttttccactgaaggttataaatttactgaacaacgaagtaatagtcaataataaaaaagctcagttgctgctgaaatttattgttttgcttttgttctataccaaccttgctgaaatgtattgtttctgcatctgaaacctagagttttctactagaagagtctaggtatcaaaaaccttttgtctaaattaggagtaacattatcgtcaaatgcaattgacagttttccaaattatagtattaagtgttaacttttagtaatcgattatgcaagattgatggctttctattgtgtgactgatgttgtgcgatcaacctttgaatgctatttttttgatcttggaatagtaagcaacatatgttttcatagtcagagggatggatggttaacacatcaacttatgttaattgatatgatcttctagcttttgtatttcatctgtttctgttatactttgatgtcaggttgaatcggatgtgggaaatgatgcatgaatgccacaaacttcagtttcagataatgtcggcagcatataacaacagccatgctaggatcaccatgcattcagaattacgtagacagattacttcctatcttgaaaatgaactccaacttctatcatcaagctttaccaagtggattagagctcagaaattctatctggaggctataaatggatggcttcacaaatgtgttcgtcatgtagaaaaatcatccaagagaaaaaggaggcatcaatctgatcttagctattatgatcctccaatatatgtcacctgtgctgtctggttgaataaacttagtgccttacctgtaaaggatgttgccgattcgattaagagtttggcaacggatactgcccagttcttaccacaccaagacaagaaccaaggaaaaggtgctcatcctcatatgtcaacatggaagcctgatattggtggcgaatcagcagatggtttattgagagatgacacatcagaggactgggttacaggtcttgaccaatttcgacgaagcttgattcgatttcttagtcaattaaataatttgtctggttgttctgtcaaaatgtacacagaacttcgacaagccattcaggaagtcaaaaattaccagcgtttgaattctcagtctcaaaatgatcatttgaattctcagtctcaagatggtcatccgaattccgaatctcaaagttgatccatcagagttacaatctcaagtggtttaggctgaaaacaaacatccacacgataagagaattgctatgaaacattgtggaattgcagaaatatagcattgtgttgagcatactagtccacaggatggagcatttgtacatggcaagatgtaataaagtcattacggattgccacacttatttgttcatttagtcccaagaatagaagggatctgatagattgcactagagagattatgagtgcatgattaaggactcagtaagagctgtaagtactaggttctgatggtgaagaaatttgggtgcaattattttgctaataaagggtttgtaccagtacttgtacttctccttgattttctttgcttgtgtcattttttcatttacgttatgtgtatataattattgattaataatattatttgaattttgtaaaggaacactcaaatggctgagagctcgtttagttaggaagactgaatgtctaattttagtattattagaccaatttttatagttttaaaaacaagtgattttgatttaaaataatctagtgattttttttatagagattttttataaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgcaataaaagaaagaaagaaaatttcgagagagaaaaaagtcaggttacttttccctttaattgaatctaatcgaatagaattacctttttggaagaaaaaaaatattaaaaatacgaatgcatatgacttatgaataaaaaatacttcaatttttcattaaaaaaatgtatattaccattttttgttcttttcgaatcataaataactgttattagcaagtagcatggttgataacctactctactttgaaaattggttaagaaaagaaaattgtcacataaaaaattagaaagaaaacaaacaaaatatgtgatgtttatattgaatagaatagagtaacaacatattatatagcacattcttactagcacaatgtttactatgtagtattaattaaaacttattagaaattacaaaattatgaataagactcacataattatattatttttaataacttttagtcaataataaaaagtttattgtctttttacagcataaaaaatttattgttagtaataaactatttgataaattttattcataacatgttaatgttttggtaaattttattaaataaaagatattaaaaaatgtgttagaaaatacatttccaaccaccatcttgcttgaaacaaggttttatacagtagttgtttcatttggtgggtacgaccaagatacggtttcttatttagagaccaccaaaccaatcaacaagaattcacattcaggaatgaacgatgaaattacttactttattattcaataaaaatcatatgcacaaaaccaaatcaaatcccaagatacatggcgcacgcgtatcagtaaatgtgctacaatgtaacattaatgtatacgaaaatttgtataatctcgaatatttcggtcctatctatgaacgaagaaaaaaaaaaccctttgctctcagcggcttttttcaccaaagatccacgccataattacaacgtttagaaacaattttggcctgcgccgttaactcattcaccgtcacatcacagttcaccttaacggtaatcttccacgtcttaacggaccccacttttattttcaccggtgccctaatcctaacggtcaacggcactctccgtttggtctgcgcctccagcaacgcgcttaggtcctcgctcctcaggtcgattccgtcaccccttaacgccgtcccaaacaccgtcacgttgtttgacggctggtaaaacgccggcagagcgccgttacacagcctcgcgtccttataaaacacgccggcggagctatccttcaagtaatggatcccgatcttgtcgttagggttatcggccttgacggtgacgttgaactccggcgagatcgcggccgcggaggacggtgaggtgaggttaattcctctgacggcgatgttttcgatggagtatttcggcgcctcgggacggaaaacgaggtagatgacgccggcggcgatggcgaggagcacgacgagaatgaagaggattccgatgagccagcagaagcagcagcagcatcggctccggtggtgtttacggcgagcgtattggtcgtagcggcgagcgttctccggcggagggacgcggtagacttggtccttcgggatcttgatgacgtaggttccaggcggaggcactggcttctccgatgacggtggagacggcggtttcggaacgacggaggagtcttgaggcgatgccggttgtgaatcggcggaaacggaaggcgagtggctggggtgaactcggtcagccattgagtgagtcagtaacgagtgaagaagctatctgaaaattgaagtgaaatgaaattgtaaaattcgaagctagaagagtgagtgaatcacaacgttattctattcattttatataacaagcaaacggcttacgcgttggaatgtaatagtcacgcggtttaagaattctactaatatattttaggcagttagcatttgtcatatatgaaaatttaatctaaattactattggataataaaaaaagaatagatattaataatattttatttcaaacaattagtaagtcaaatttgattttttcttttaagaaaataatcttgtaattatttttatttgtttagatattaattaaaagtttaaaaataaagttaactaaaagattaaatttataatttataatgctagtataatttttaaaaaatattaagggacttttcaaaattaaattaagtcaaagttttttattggtaacttcaaaaagcttttttattagatggtagtagtcaaaaagaacacaccctatcaacaaatgctgcattgcacgttggaatcattgttgtttgttagtaattaattatatatgactcacacttacccatatggaacattttttaaatctcccaaaattaattaattagaactttgagccgtgactatgaaattagttaggatcatagatagaagagataaaacttaaaagacaacgaaactatcaaaacaagtgcatgaaaaccataagaaaggattataacttataagtgattatttgaagaaggatatgataatttaatatataaatataaattaggtaaatgttaaatagtgaaactgatttagaaattaaaaaggagaatttttattattaaaatacacaaaattaaaattaaattgtttataattttttatactcttttataatttctacaatattttttaaaattaatattctaaagatactgattattaaaatcctatacagtaatataataactaataaacataggagggaaaatggagtacagttcaatgtgagatcactcacggttggcaagtttagaaaaaaacacacgaaagcaaagaaagaaaaatgaatgggtcaaaggagtgtttggatgcaccatttggaattttggattggcgtgtatctaattttgatgtaaacacacggtatgctaattgttgccgattcgttttgtctacgagttagttggcgctttgccacacgcggttttgtttcttatggactggcctcaacccttcaatgctttcctttttgtataagcatttgtctttgcaccaaattagtacgctttatgaatgtaatcttttttcgtttataaaatggatatccaattaatggcttttacctaatattttttttttcctttaacttgaaatggtctcatgggtcaatacttaacaagaaaaatatacaacttgctcttctaaaagtgtttgttgcaataaatttgtttgcttttctgcttcttgtgcaaccgacaaagttttatcaaaacttgtataataattaatttgattataattaaaaaataatcatttacatcataattaattcaattactaataaaaattataacgtgtatattaaataaactcaaataaactccaattaaaaagttaatttgtattataattaatttgattatagtaaaatatttttttattgtaactaatttgatttcaattaaaaagctaatttgtatgataattagttcaatattaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgtattttgaattaattagaaaaagaaaatttgtttctattatgtagtggattgacaagagtgggtcaatctataatatacaatatttatttgtaaaaaattaacacattaccaatttatttttgttgagtatttgtttcacatatataacacaaactaaacaagtttttgtggtgtatatgttccacatacattataaaaataagattaaaatatattttttgtccatataaatattgaaataattaaaatttgtttttggaaaattttgaatatgtttttcatcctcacaaaatgtaaatatgtaatattttggctcggaaatggaattgggagatctaatcctaggtgtcaatgtcaagtcctcgtaagtgagtcaacatgttaactgaaacttgtcatgtgtcaattagaacttggtgtgttgatccactaacaaggacctgacgttgacatatagaataagatctcttgaatttagttctgaaccaaaatatcacacatttatattttgcgaaaaagaaaaacatattcaaaattttatagaaacgaattttgaacatttcatgttaatagaaacaaaaaacatactttaacctaaaaacaaattttcgttagagtatacaatgaaaagttgtttctatcaacagtatttgtgaaaaaatacaaaaacttgggggtgtaaacttaggattaggattgagaataacaggggccgtgattgaatgcttaatcttagtgttggcaagcacaccggaccactattagcacatgttattcccacactcattttcgtcattaccacacctccatcacaaatatttactccttacatcttaaactaaatgtcatgctaaattataattattatacacagacaaaaaaaaagttaattaatcaaataataataattttacaaaattaaccttattaagtacttcctcctttgtaaaatatgtaccacatttgaaaaaaaaaattgtatcaaaacaagtgtcactttaagttttgaatgtaatattaattattttttcactaatactcataatactactctttttcatctattaaatataaattagttttgtaaaattattttattttattttttcatctatttattaatttttcttggttaatttgtttaaaacaatctaggaaagagaatgatattagttttatgttgaaaaactaaagtaacacttattaagggtataggtgaaaaaataatattacattgaaaaacaatttatattacattgaaaactaaagtaatataatacttattttgcgatattttttattcaaatatgacacttattttgggataaagagtatatttattagaaaatttaattatgatataatttatggtaaatattaactagtaccctaaggatattggttaagaaacttaaagtaaaaatatttttattagaagtcggaaaattgagttgttcataatcttttatgcttttttatgatttacataataaatattttttattttagtttcttaattaatgttctaatgagattggttagcatgatttatatattaaaagctatttatttattataaattttaattatataaaaagtaaatattttttaccttatacactgtacatactaaacactagtttataatatttaaaaatggtgaaaataataaataataatctttaaataatttctataaaataacagttaaaattatgaaaaaattaaataaactatataataaaatccaaaccaattagaatctcaattattaattttctaattaataattattattgcatgaacatgtaaattaattgacacgagattactcttagcttaatcaaaaaaatttatcacctatagtaatttcacaagactcaaatagaattacttctcattgaggatacgtgtcatctatatcaaaaagtaattttcttccttacataggaacaaaatccaaattaccaatgaaaagtcaactaaatcctaactatgcctgccattacaatttgccaaatataaatccttcttgcacctatataacaccacatccaccattggtctcatcacagaggggagaatcacaactacatgcagaaggaaaaaattaaaaaaaaataaatcatggaagctcaagctctactcgccctcactcgtctaagcatctatgcctcaggcatgcaagcacattctctttcccctctctttatcatttgctattatataccaattatatatacaactagatcacaaaatcttgttttattcttcaccaacaaaatgttgtatacacatacatgttacatatcacaggtgcacacagtcaaattcacattcacaaacaattgtgcattcacagcgtggcctggaaccttaactgctgcaggaaaaccacagttatcatcaacaggctttgaacttccatccaagtcttcattttccttggatgccccagatgggtggtctggtagattttggggaagaactcactgctccaaggacccttcagggaaattcacatgtgggagtgcagattgtgggtctggtgaaatccatgcaatggtgcaggtgcaactccaccagcatctctgatggaactcagactagcctcaggtacacgttctctaaccattttttttaatctgtggcaatcgaagacagatatcgggggtttaacaactcacacactcagttcaaccgagttaaacctctccgtcgttctctaacctttctatgactattattatttgttatgaacatgctatcattgatcagcatcatttgttattaattttccatcatcagatgctagtggccaagatttctatgacacaagcctcgttgatgggcttaatttgcctctctcattgactccacaaggggttctgggttgtgcaacactactagttgcccttctgatgtgaatgcagcatgtccaccaggtttggctgtgaaaagtgattatggaagtgtcactgcttgcaagagtgcatgcatggccttcaacatgccacagtattgttgcactggtgattttggtagccatcagagttgcaagcctagtgagtattcgaaagtgttcaaggggaagtgtccttgatcagtcttatagctatgcttttgatgataaaaccagcactttccaatgttctgggaggcctgactatgtcatcactttttgtccatgattctataaattaattagctagttggttctacctgcttttagtataaggaagtgttcagataatcagatgtgtttatgtatggcttgagagaaattgcaaattcaaaaggctaaacaattgtaccaaaagtatgcaaatacttatgaaatttattatttccttcattagattcaattatctaactaatttatgaagattaagaaaaataattagtttagttaacaataaatttatcttaaattcgtaactttctagaattatccttgtaattcatatttatcttttctaatcgttgtcaatacattatcaatctctcttttgtaaattaggggtatttgtattctaaaataattaatgcaagaaatattataaattaaatcttataaaaagaaacaaacttcattttaaatttagatattagatattataaataggaacaaaaaaagtactaaaatattaaaatttatgttgtttaattacttttttagtttggagcatataatttgttttaattacttttaatatcacaaaggaaaaatataaataaaatatattttttgttctcataaaattgataatgtatgtttttttgtccctgcaaaaattttaatttattttttcattttttaaaaattgaaatatattatttttttgcttagagtaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatttccacatctcgaaaaaaaactactttttaattatcactgttcactggtttcaaaattttatatttgtagtattttagtatgagtaatgtacaataagataaatatttatttttatatagttaaaattataatcaataaatattttttaattataaattatattataattaagatttgtaataaatgaatattttttaaatgtgtaaaatatatattaaatttatgataaataatatatattttgatataattattttaaatattgaaaattattataaaaatattataagttcaattttaaaataaagatgataatgataaattgaaaaaataagcaattaaaaaaatcaagatatatataaaaataagacgataataatttgagatggtcaattaaaattaagtatatttaaaaggaataaaaattaaaactaaattaaatattcaatatatgtgagattgggataatatacgagacagagagataataattcttaaaaacactttcatataagaaaaatcctctcattgaagaattgctcttcaaaatactcattctagatgagaattcaaatttataatgaatggaatgagtatactgtaatctttttacatcattaaaattttcctaattcaagaaagttaaattcccaacccccatgggaacaattttataacaatatacgtcaaaaaaattcttggaaaacaatattttgaggttcttttataattatatatcaagcatgataaactaacgtccctaaacttcagattgctggaaactaaaaatttccaataccaatcacctaccaaggttgttacaatgtacatgtaccaacctgtttaaatcaatttcaaagcatgaaaggaagagaaataggcaataaaagatgcaatgggtttggatcatagcattattccattgattgcagcgatggcaaaaagaacgtcaagcaatatcaattattacactgaacaatactgcaaaattcatgaatatacaacctgcccattgaagggttgaaaagaatgaatgtcctttgacaaagaatttcatttcatatcctgacttgttaatttgttataatgcctgtggagagctgtcatcaagggaccaaaattcaacaaacttgaaaagaaacttaaacaaaaaacaactatagatgatgatgatgttagtggttaaggctatatgatatgatcagcaactctaccttattgttgagagatcaccaaagacagttttcatgtcaggcctatcagatgctggaagcatgcatctaagagccacctttagcatttcatcaagaattttagattgtctttccccattgtgcttgtccattatagacctatcaaagcactggtttgaacggtcttgttcggctaagaacctcacccagtcagtgagatcaaccacccctggaatcccagaaactatttctccagaatttcttcctgttaggagctctaacaagaccactccaaatgcatagacatcacttgtcagggaagggcatggtttgcttgatctagaaaactcaggaggtcgataaccgagtgcgccagcattcagaacttgctcagcagtaccagcagcagtgagtattctgtgcaggctgtagtcagtgaggaggacatttctgttgggagtttctagcaaaatgtttgtggatttgagatttccatgaggtatggctttctcatcgtgtaagaaatgcagacatcgcgccacctctacagccaccctgagcctttcatcaacaggcaaaggatggagatttcttttatctgtctctgcagaaaaatttgaaacaactaaataaaacagaagtattacaatttacaaccaaaagtctaggtgttatgctgcaatcaaacatgcatgaggccataatcttaccatggagatataagtccaaagattgtgcattcatataatttgatataatcagtttctcatgttcctttggccccaagtagtaaccttgaacagaaaccagatttggatgcttgatagtcccaagtttctttatttcccttgccaactccttttttcctttagttattccttctcttaaccatttgacagccaattcatgaccagagtcaagtgtagctttgtagagtgttccatgacagctcctgccaataacttctgctggagcacatgaaagttcttccgcagttagcaccaaggatccatcaaatatatgcaagtctccaaccagtttatctggagaggagactttgagtgaaccaggattctcaaactgatagctttttgaagatgaaggatttgaaggtgacaaaatagacattggggtagatgttccttcctcgttcttacctaattcaaaagggccaggatctattggcttctttcccactggatgaatgtttattgcatcatcagaagaccccctttgagcaggtggtaatgtttccaaatttctatacggtgcctctgtatttgaggtgaaagtactctcttgggtggtgctccttgcttcattttgtttagaagtcctttctttttcatgatggaccttataataaattattatagccacaaaagccatcacaaaaccaccagcaaccaaacatgcaatcagggcaatcctagttgcagactttttatgtaaccgatgttccctcaaacctaggttggaagtatcttttggtgatgattgtgaacgtggaaataccagcatagtatttcctggatgaaatgctgagtcaggaaactgctttaagctttctggcacaacaccagaaagattattaaaggacacattcaatactctcaactcatctggaaggtcatcaggaatagtaccttccaattggttattgcatagattgagatatgacaaattgtgaagcctactcatatttaaaggaagagtcccactcaagttgttgtgtgaaagatcaagaaacaccagactaaaattttcagcagaaactaatggattatttggaggttgaaactgaataggaattgatccagaaaatttattgttggagagattaagattaatcaatttggttgaggtaaaaaagcttggtaggacgaacccagaaagctggttgaggctaagatcaatctcttctagttctggatatgttcccaaaattggtgggagaaatccctccaatgagttattggataccttaagtgcagttaaccttaaaaattgagaagtttcatttggtagcattcctcccaatgagttggcacttagctgaacaacttccacatagttaccccaataccggatccttgagaaattacctgatagtgtgttgttactcaaatctatgatggaacagtggcctaccctgagaggtaaggggccatacaacttgtttgaagataaattaagcttccgcagagtcaccgaggtaataattccaatgggacctacgaagaaagtttaaattgtaaaagaggaaaagggtaagcagaaactcattgaataacactttgaactcatgtcatgtgtgattttatgatattatgactaaaattgatgaataagtcaatgctaaacaattgggtatagacaaagggaacaaagtataccaagatttctacatgcagaatagattgtttgtcacatgtagcatacttttggacagattttggaattacttcccagctcccacaatgttagtacatagaaaactaaatggcttctataaggattaacggatgaatacataaaaatggtataccctggacaccaacttcattgcggatataggttaccacataagaattttctgcaaagatctaaaggtctgctaatagttgcatacctggttgtatactatccaaaagatcccctcaagagggtttaacatcaactacttttcttccttttcaaattttgcatctcaaactgactccataaatcaatatattggactgatgctgattatatgcaaccaaaatactaacgttaagtttttaatatactatgtattttataaggttacattagttttttagttccctaatttattttttagattcaatttagtcttttaattttttctgggtttaatttagtcctctaattttttaaattaattcaatttgatccttcagtctaaattgtaagaaatcacactttgtgacggttcaaaaccaccactaagtggttttaaaccaccacaaaatgcacattttccaaaaaaaaatgaattggttttaaaaattagaagaccaaattgaacaaaaaaaaaactagaggaccaaattgaatcaattttaaaaattagaggaccaaattgaacctaaataataaattagaggactaaaaaactaatttaatctattttataattaatgcaggcttccttagtacttatttggcatacagaattatgtttgaagtacaatttatccaacaataggttgaaccatggaacagaaacttcaaattggacaaatataaaattttctttaatttgagttctccactatttcatatacaggtaagaaatttatgaaataatttgtatttcagccaatattgatcactaatagactttcatttcagtttggtcaccatgttgtactttcctctacaatctttgttactagaaatgattgagggtgtgaaaagtatttatttattccacagaagaaaattccccaaagggtttatctaaaataactaaaatagcagaacagggaatcagaaagaaagttgcagtttcatatttcagcaaccaaacagcagcttgatatgggtttttggcagtagtttttcatagctaaaacttcatttatgaaggttagcagaacggacagcaacaaatggggagtagactagcaatttcaattgcattttgagtttagatacatttatatagaaaatggataagttttaactttgaaggaagaatatcattacaattttcacagaaaacatagaagataccttcaagcttgttttgactaagatccagttcagacaacatcattgaactttccttcaatagagcttcgggcagtaaaccagtcaactggttgcatgcaaggcgaagaatccgaagggataccacaaacttgaaggaaggtatattaccctctaactgattattactagcatcaaagacctctaaattgtcaaggtatggcataccatcatgagcaaataactcaccattcaaggaattatggctaatatttaaatactgaattgaagagagaaatgactcatctgcaagtcccaaatccggtgtaccagaaaacctgttgctgcttaagtcaatatatagcacactgcccatctgataaaatatatgcataatatccccagagaacttattcatgtgcaaatctaaatacttcaactgctcaagtttgtgaaactcaataggaagagtacctccaagttcatttgaagaaagattcagatatattaacttgcgcaactgagtgaagttagagagtaacgggccattaaacttgttgagggacaaatcaacatattcaagtgattcaattgtagcaatatgtaagagatctcctgtgaactggttgttcacagcggacaaattgcgaagcattgtaaggccactaattgcaagcaaattaaactcaccaaccaaaccagcattgtccagagtgattgatataacactgccttcactacacactatcccatgccagttcttaggacaaccatcggaatctaaagacctggaatcccaagaattaactactaatccagaagggtcattctgaatactcttcttgaattcaaggagtgaatcaatatctgaattccccaatgcaatagccaccaacaacaatagcatgaacaagatagcctgcatgcctttcctagtagctcctaatccaagcatcaactaaatacaaatgattatatgagggaaagcaacacaatggaagtgagagcaaaggggcaagccgcaagtgtacaacaaaaaattaaaggcaagagagtaattttagagcaagttattcaaacaatgatgcattcttacctcttaattcacaagaagtaaagttgagtaatgaagcatgtacgcgtagcaactgaagtaacaatgctaaccaaagcaagtagaagaacaaattcagaaggaacaagggaaccccagtacgtttctgctgttagaaaacgaatggttctgagaagatgaggtcataaatctgaacaaggggctgagtagggtggaatgcagtgtggcaagcaaatgattaggggaaagttttgattttgagagaagactagtagcacaatagtgtcatagaacaagaagaagactgaggagacattaactgagaacatggtaggtaggttgctgttttatcatgtcatgattaacaaaatcatatacagattaaattcatctaaattattttatagataatatcgataatcatatagcagaatgatgtgttgatcctatttttcttttttatagcatctcttttaattattatctctttttcttcacattttctttccttatatatatcttaagtactatataatatattaacttaaaaacaggtgctatataatatatcacttcacttcttatatcacacttttcaataaatattaatatttttttgacagagactatttcgttctaatatagtaaacaaattaatatatcacttaactaacattatgaaagtgaattcagaaagaaagaaaaatagaagagaaaagtgatgtttacttgatgttaaagaactccaataatttttaatttttaagggaaaaaagaaaaggtttgtgagagagacttttcaagtcgacgtcactggattgtccccagatacaaagcaactgtatatgacctcgttggcagcacctttgactttaagggttagtttggttctgcctccgaaccttcgcattaatgcaaaaattcatctaaaattttatagataacgcataagtaatttttagttgtgcgacacaagtccaaacacacggaaacttttatttaaccacatctttctattttttactgtcttccatttctaaggatccaatgcaaaagcgcgtcctgtcattttcaaccttaagcatttagtgtgtatttaatttgacattgatgaattgattataaatttataattgatccttaatttatttaatgtaactttaaataatttttacattaaatttaaaattttatattaaattttactcctaacttaattttataataaaatatttaaatatattatctcacttcaaaatcaattctacaaaatcatgttaatgtttatccaaacaactcttaattttatgaatctaaatgaatgaattgagatattagtaaaatctttaatatgtttttttaaataaataaataattaaaacttgagattgaattaaaaaatatgtttaatctaaaagtttcaagagaaacttaaaaaaacctaggtgaaacattactttactttctgagacaataagtaataaataattattcaaataatttcagagaaatattaattgaagttatatttggataaactctttcataagtatttatacgttgaagactctctaatgatgtttgggagttgggatccttaattgagaatgtagaagtattgtttctcataatcaaatatttgttgtaggttttgtgaagagaaaagctaataaatttgttcatgagttagcaagagtgaatgagtgactctatctttatctagctatacttttaattgtataattcctttagttgaacatttactttataatgaaataatataaatatgttttagtaaaaaaaattataaattgaaaatgaattaagtttatcgcataaactaaaattaagttatatatttttttataaatgttcttttcatgagcaatctatctctcattggaccatacacatacgagcattcatgaaaagatcttgaaaagatgcctaattaaatgctataaacattattgccagtgaagcaacaacttcaagaactgaagaatgttgagcatgagctcccactcgaagtatccaagactgaagaggagcaggacaagctgaattttttgacattagaacaggaccttgaagaggcgtgacttctttcaaggttaagattagttattcattataatcattagattttaagaaaatgaattatgaggatgagaagtaactcttgaagtgtaagttaatctctcttcatctctctctatatatatttatcgtgtaactgaacatgtgtaatactctttttcagtctccagcagattaagattggaggatttgttgaaagtttgtggaaaaggcaatgcagaaaggtgatcacacttgacctaaacttggtcaatcttttgtaccactctagctttaatgactttagagaaaactatttgattaagcctacccctaaatttgtgtgtatgtgcagggtatgggatgaactttgcaggaccaaatatggagagagctcctctgggaaaggaaaaagctccaattccaaaactgaaccttttgggactggatagagctcctagcatcaatctgagtcatctgggaacacaagttataaactggaatacaagtatcttttgaattaaataaaaattatggcaagtaattagtaattactacaatgatagttagagtagtttgaaacaaacttgtcatactgctgcttctattgataattttttatattaaagaacaagctgtactacaatggttatttttacaagaatggatattcttaaggattcaatttatagctaaagaaatatgattatatgattagtgcgggaatgaattctctacaattttttgtcccagcaacgagttattcaactttatggataaattcatttattatatgacaaatttagtacttatttttgtttttggtagatctaagttgattcatggcttcaaataatctccgaataccatgtagcctacaatggcaatgagtataaaggctaatgtgcttctgacaaagcaaactagaaaaacatggggtaaacaatgagtgttatttttactaaatgaaactaatggcgatggatccatagctaaatgccaaaatgtgtttctgacaaagtaaacttaacaagcaagtttcaataacttttgcttcatcttttggatttgaagtatcaattaatcattttttcaagcctccttttctgtagataaattcgaacaatcaaaaaacaaggatttaattcttgaataaattgcagttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtataaggtagtttgttttaaacattaaacaaggataaggataggtattgtgtgtaattcgaaaaaatctcaaaggtgttaacataatttgctctttttcttttttgataaaaattaacaggtaaataatatatacggggtccttatacgaggtcctttttctccaaaatacatttgatcttaatagcaaacgaataatactttgtctataatagtttaactgagacatattcggagtcatatttctctagcacgaagatatccaattggaatcgagaatagattcacactttgttacaacattttcaacacattcgaaagctactcaaaccactatcatatctcaattcgttcatagacacaactcaatgaagagcatgacaaaaatggaacctttttttcaagaattttgattttcctttatcgactccttcaaagagaacaagggatttacgagaatgtttagagttgaattttaaagagaaaaataatagaagcaaaaaaaactattttgtaataaatagtctgaattaatgtttttccaaaacaaaaataaaataataaatcaaaatacatttattattttaattttccttttattttataatactatatagttctcgtagtttaaaaatgaaaaataattgttctgggccaaccaatgtctaaagtgctccaaaattaacatgtaatatcggcccaataagtaaatagtgtagtagtgtctcaaaagtaatgcaatgattacactctctgccttaacgtgattccatcaccttgggcatgcaaagcacttttagtctcttccttttttattagaaatagcttgatgctctgtttggttctgaggagaaaaataaactagataaaaaataaaataaagataattaaagaaaagaaaaatagaacagtagaatgataaattgtttagtttaagagaattagagaaatatctgagaaagagaataaaaataaaaaaagtaaaattctttgattaaaagtatcatcttataggcccaaaatggcaaaatctacacgtgagttggctataaagaaatgttgtattgttttgcattaagagcacaaaagtaagaaatactttgtccacttaaagagaaagttgtgagactcgttgaattttaaagttcactccataatttttttgctatcaaatgtcaaatctcaactccatcgtaactttgatttgtcatgttgtaaagagaatagttccttccataacatatggatgtaatttgatattgcaaacatacattataatcaactcctcaattgcttaatttaattagaaacttcaatgttttttggtgaccaatatgattgatgcaaattatccaaatcttatcactaggtcagtcaatcctatggctagaaactagaaattttagtcaagccatcaattgataatttgctatatatttgtttgatttgttttcacgtttccttttcccactgtgatgcactacctaattctaaatttgaagtttttaaccacaataccactctcatccacgaaaaaaaataaaaactgggcttgtaatcttcatcttactgggcctgggcccagttcccaattcttgatcgaaacactcacatcatcaatttccagtcacacaagaaaagagggaacactatttttttcttcttttattccttcccttcttaccatgatttggacatatcctgtattatttaatattatatcatttttggtattttattagtatccttttgactacgacgttgatagtaatatgccatccgtgatagttaacagtggattaatgatagagacgtgactaaatgtgctagttttgactttaaggtttctgaaattatacgtgtaatacactgcacaaaatcaagaaaaaaaaattatacaaattaaattgcgcatgtgtttttgcatattatactgcagaatatttgtttatttgaacagcttagctgacatcgtatttaattaagtggtgttattcatacaacaatttttatataataatattttttttctttctctatttctattagattattaattaataccctgattgacaaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaacaaaaaaaaaaaaataggtcagtaaagttggtggctaaaatttgcaaactgtttattatataaaggtaaaaatagtatggataactgaaaagattgtaaactcttaagtctttagtcttaacagatagatgcttaaatcaggatctcactaaaagaaaacatcaaaatcacatgaaaccttttaaactagttaacttttatatccttttactttggtattagccaatatccaatccttgaaatcaatctagaagcaactgctgttgataagaggtctctctagagaactgacttatttgacacttttggaatctccatatataatattttgatgccacgaataattttttttaagatatatagtttaggtgaaaagagagagaaaaggataagcatatatagaagccactgagtaactcaaaaaggtgaaagaaaagaattacatattttttacatatggagttgccatatatcaacatctatatgatcgaatttaagctgagatgctgccactagcaagggagctatcattttgggaaaggtgggcggcatgagtgcttaatctacaatgtgacatgtgaaagttcctgttgtcacacaatgtgtgtagaaaaacagatatggtactatagcataccccacttcaatttgtttgctaaattctacgacgtggcttcaataattgagtaaaaagcttcattgaaagtttgatatcttttatcttcaccccctcatcattttcaaatgagttaaatgatctcaatattgaaaaaaaattatacagtaaatcaattagaaattatattgaataaatagtgtatgtaatgtattaatagtataaaatactttttttccatcattatttaattataaattattatatataataaaattgttaagtttttatcataattatttaaaaaaattatatcaacagttatttctaactgacatgataatgtaaaatttttatattgatcaaacacataacaattatactcataattaattttgaagttaactattataatttttcatattttttacaagcaaagctttattagaaaacatagtacaagtcacactttaacccgtatacaatcaaatcatatcaaatgaaaagaaagaaagaaactgcaaaacctatacaccaataataagaaaaagaacactgaacatatattatctatttttttttccttaaaccatattcaaaaaaatctaacttttatcacatctaaaatattattgaagacaattttaccatatataattaaatgaaaaaataaagttccttgcatgcatgcacactatttactctgttctaattaaacaattaggcttcaagttgtttctataatacacaatcatcaaatactatagtagttgatattgagaaaatgtcaactagtaagtgatataagtcaagaaactgtggcacacattgctattttcgaaaatataaggtatcacacatgtacgcacaattctgctgcaattatctatcattttgtggctctgtatagtccaacatggatgcaacacaagaaaggcatgcatatggccagctatgccgctgtcttcctttgtatttaagacaaagcaaaactaagcaaaagcagtggctgggggatcctagagttttcttgcttagtgtgctacctacatcagattcagatcgttaactattagccataatttaatttatgtatatatacatagtaagctagacccttatagttttcaccaataatttagattttagaaacatagaacctagtcaaccacgtctctaagttattagcagccaagtctacagtgaatggtttccattttttaaatcttttagctaagcaaactctccgacaagaaagggagagagatttgttcactttatttttttttttcaattttcattttgtactatatatagttttataagttattttcaatattaagaaagaaaacattgattacactttggtattttcaatatgagatttgtgtctaaggaaggagagtacactttaaatgataaatggtagtattgataattataattactaattacttataaaatttgttgtatactatatattttatttttatcacaatcttaaatattaattttttaatcaaccattataaatgatctttatatttttaagtaagatgtacttagtatcttttctctttcggagaatcagatccttcaagtgtaatattttccttttaaattttgctagttaagactgagaggttcacaaaatcctagttttatcgagggggtcattttcaatttgttgaacatatctattaacattaactatgtagattaattgatgtatcttgtataaattgataaattaatgtttgttgcagaatgcagaatgcttgggagttcgatgcttgcagttatagatgctaagaagcctgcatgttctattgtcagcttcctctgcaagaatatttttcgccatgcatatgtggaagtcaaaagtcactatctaagaaaaatgttgtatttgaagaaccaacatcaaaactaaaactattatctggacactgattttgtatagcattttacaatgaaaagaagaagaaaaaaagttttcaatttgaacgataaatttcaattaacctgtataaaataaatttttttaaaagtaattcaatgggaatgcatactaccattttaacaagtatatatttagtgttattatcttttttgttttctccatttttataattttaacctattgtctataatttttcagtcgttgtcaaattttgtttctttattgacaagttttattcctttttaagttcactaagtactttttattcaactacacgttttattttatgccatgttctattttcatatttctaataatcatggtttttcccctcaaaaaaattaatcatggttttaaattgatcaagaactgaatttgcgattacaacgtaaaaggtttatggatttaccgcaatcttctcacaattacaattacgacaatgtcaaccgtgtttttcacaatgtcaataatcaatctcctaacaatcgcaattatgaccatgttaactatattttttcacaaatttttacaatgtcaagaatcacgtcaagatcgcaatcatgattcccttatgagttcaggttctagattcgtcaaaatcaagtttataattttaacatccaaaaccaatttagattttcttcttcaaatcagttcaggttaatctagttattggataaatcagactatgtccacccataactaatcctacaatacatgggtttccccatatgcaatctttaacacattgcaattaggtatactaccctttcaaaccacctcgctacctcactgaatttggtgacaattgtgccacttcacatgataattatctacacatgccccttatatgtaagaaatgaaggtactttccaaaacattaatgtggcattggcacgttaactaggacagagaagagaattgggtgcaaattcagcagcctgagctaagactatccaagagatgtgcccctttcattgtctcataaattggcacttttctttcaatgaagactcaagaggaaccattccaaagcacgccaaaggatttgactgcctactacaaaaagacaaagacaacgtgtccctttgaaaagaccccaccacaccactagcacacattcaacatgatcacgcaattgaatagccatgtaatgtaatttggcatatgccaaacaaactttggatgggaccattttttcattgaaaagataagaagcacagcacatcagatgaatgagagaaagatgcaatgcaacaaaggctctgccaattgcctttctctcatctcatccaccaatctaatttttgttcccataataaaagagcctcatattcagattccttgactatgaatgtagcagtggaactacgattttataagagaataaaaatctttttatttatatcacagtcgtacatatgatagtaagtaacaacatagggctaacacaaagagacacataaaaagcgttacattatgggaacacccatgatttattaacccataatataatacccccataccagacctaccaaatcataaaatatctaagacctaaacgattacatgggaagaaaaatgcattaactgccgtttgagtcaagagactttcacatgaccccctttaatgacacaataaaagtccttgatacacgagtttccctcttgtcattttcactggtaccaaattgaaacctcttgctgtttgtgaagagaatccattcctactccttgtatatcctccttgaaatcaaaggatgacaaatcacaaggggaatcaaacatcgaatggatagtattattgttgtggttggtatcaaaaggagtgttcatgttcatgttcatggtggccttgaaccggtcaaattgaccttcctctcgtgcaaagaagttcccttccaacaccattccttgaccggggaaaaaactgtcctgttgttgtaatccggtatgagaaaggttatgattttctacagctacacagttggcggaacttaggttcttgtttcctacaacatttgtatcatagattgtcataaggtcactaatcattttctggccatcctccggaactccaagaccagttagatcaaatgaaggtgcaaccaaacttgcagactgagctgtagtgttgggttgaacaaaggacttggggaatatgactggcttaacctcagtagcatggaaattgggaccaccaccataatctgcagaactgtttctatatgcacaattcaattgatgattgtccctggcagacctatcctggaaaccaaggcgaacttcactgtaagggcattggggatgctcacatgtgtagattttctgatccatcatcatgttgaagtcactagaaattttcctcttccggatgaaatctaggtttgtgacaacatctcccttcattggatgagaaggttgctgaattggcatccttcccctcattctctccatcccaaggtttgacggatgaagatggtcaggcttccggtcctcaacatcgaagttcggctcttcttcggccccgtcaacatcatactcactgcaatcattgatcaccaaggatccattacctccagcagaggagaatggagggcaatagtcagggtaaagctctctagccaaggtttcctcttggttgatgatggcaagccaggttgcactttcctttgcagtcattttgtcttgaaggcatttggactgcctcacaagcttgcgaattttggcgatatcaggggacatatgcttgatgactgcagtgagaacaccaaccttccacgccttctttaggtcatgtggtttcttgtaaggtggagggccttgatctttaggtagaccaatttgaggccaccattcttcattcccagttggccaccatggtggaggagcacccttctctagtgggaacctcctctgaggaggatcacagtgctgcataagtgctgacaagagagaacccaaggttgtgtcctgtaactcttgcaaggtgtgtggtgtaggaccaatggaattgcatccatcattctttccaggaattgcattatcggcttgatacttagctatggcggcaggaccatttcgatcaaacctgaccttatccttccaccattcgcgaagattgtctgatgctcccgtcactggcttccccttctcaggaattatcccataaacaaacccttgtgccttgcaaacctccatcatcttcagcatgtacttcagtattccatcttgggctcttgacatctttttcctccttgcctgctcttgggattgcctttgctttgctgcatcagtcccttccttggacttggtttgttctttcaatcgcttgtgacgcattttgtccctccacatcctcttctcgagttcatccatatccatttcttcatcactgtagtcatcctcaactacaggatacggttcagtttgcctcacagcaatatccccctccccaagagaaccacataacatatccaaatcgccgcagaaccccatatcttcaaacatcatcatcttttcccagataaatctccagaaaaagagggtttaacctatgagctttcaaatgaagtgagtaacaaactgggctccaaatttcacccccttcaacactataaaccactcaatttgaaaatttctaaagcttctaatggcctttacacctgccaaaagttaaaaacagggaacaattgagacggtgcaaagatcaaatgatactttccagatgaagcgaatatcaaaattcaaaagcataaaatctatatcaatatcttgtatgagattcactagcaacccaactttcaccagcacattttttctttcattctcatccagccatattggatataggctaaaaagtaaaatctaaagttgcttatcacctatgttgcatagctacaatacaaatacatcactaattttaaagcatcgacgcatcatatcactaaatgaaatctcaaaattctcgttttttccccctaaaacaccattcatcaaaacagttattggatcaggattgttctgattgaatagatccaaatcaccaacaaatttaaaaatgaaaatagtcaaaatacaagcaccaaaagcacatgccatggttcaacgattatttaaaaaaatgaaaacatcgctcatcaacccatcatcaaacatatgacgactgaaaggtttcaaaattttctttccaaaaacagatgaggaaacaaatcaaaccagccatcaacaaaggatctaaggccaaaccaatcactcagaaacccgaaaacactataaatagcaacagtcagcaaagaatacatacatacatacatatatgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacacacaacaaaaaaagaaacaaaaacaaaaaggccagaattttatagaccaagcagcaatcaagaaggaactgaataatgaaaaggagatttttttcttcatgaggagaaccttaccagaagatccagaagtgggttttcttgtgtgaagaccaaaggtgaatagggagagaagaagaagaagaagaacttttgtagaccttgagcagaaaaaaagagatggaagaagaagaagagaaaagaaggagaggaaggtgggaagaaagagtgagtaagaaaaggaacagagtgttgagcattatcttgcttttattattgcttatggtggtgctcttggtgaacgtgtagtgcgggtgtcgttcattattggtgggattaaaacattgataaaagcccaaatatgtggagtaattcaagtttcagagatatttataacattggtttaggttaatctcatcctaaccttgggagatcggttattagtatttattaaatcattaattatgacatgatgtgtgaatatgattaatgaagtttcagtttcagtttcagtttttactttattttagttgtgtgtggggtccgtgtgcgtatcgtatattattgaaacatgaccaatcacaaaagtccacttacattggtaacagacaccaatacaagcttttgtttaacatgttacaaatctcatttgaagcagacaaatgtcaagcgaattgattaagaatgttaaaagtagaaatatttttattaatatatatatatatatatatatatatatattatgattatttttatattttttatgactttttgtaataaatattttttaatcaatatctaagaacacatgttaataaacactttaattatagtatatggttgtgttaaattcttacataataattaataactaagacacccaaatgatttgcctataattatatacattaagattatattcctaaattatgtgtatttgaatttttaaatattcttaaataataatttataatattaaagaagaagaaaaataaaaaactaaaatgcccatgtcaaaagatcaagaaagacaataataacttccacattcccaatctatcttttaatataattaaataatattgaattaattaatctatctatctattaatattttattaatataattcaggctgtctaagaggacacctgtcacttatataaggacctacccttaaactctacactgccaaagctcttcagcgctcaaagcatctctctcacttcttttttaacggaaccgcccatcccctatgaggtactaaggttttgtttatttagttgcaaagagataattgtttccatttaagaacatttaattttgaagaggattaactgtgacaaaattataattaaaaatgttaatttgatttgtgttgtagtacacttaacttgaagaataatagtcatatgttaaacaattaataaatatatttcctattatgaattaaaagggatcgacatatacaacaattctattttatttttacttcttatgtcatacaaaataatatattaatgttatacttgtactgcagaatatgttcaaacaaagcaagtcagtgagaagattgatatattcaacctttgtggttatactgttggagttgccaagtgctaaacaattgatgagcactcatctcttgcagagtgggcatggcgctgtattttggttattgttagttaatgctaatatatatgtataagtaatttattttatgttttagtccatgttgttagttctctaacagaggtgtaaaatcgtcataaaataggaacacaagcaatgttaaattgtagaatctagatagattcaatgggatgaactaaatcataaaatcttaaaaaggtaaatcatatataaaagtctacttcaaataaaaaaattctgaaaacagtaacacacaaacactgaatcagcaacaattcgacaattggacagaacacactcccaaacacacagatcactcaacaaacacaatagcaaacacacaggttaggagtgaccaaatgcttgtcacatgcttaattagcttcattgtgtatatataattctaatttaataatcttgtttgtgcaggctattgtgtactcctaatgaagaggtgtggctaggagtgagtaaaccaaggaactagcatgagtagccccaatggaaccctcaaattggactggatctgctatttgtaagtttaagttgctccttagctaattctttttactttagtgcctactgttcattttcatttcattatatttttctctctttttcttttcagaaaacgttgaaatatgaaccttgcaagaggatttctgcaaagaaagcaatgggacatccttacttggatgacctgcacaagaggcaactttagaaagaacacgttgatttgagatagatttggacgtagaaatgtgtcattaccaacttacattttgagatagaaagatggtatttactagatgggattataagatgacgtttcttctacacaataaaaataggattataaaataaatgtatctgctaacacttagatggtccatgagttttattaatcagagtctcataagttttgaaacaatatgaccatttttaatactcgtcacattttatttagcagttttaatgccaaagataaaactgaaaatcctatatttaggataagatctcttgcatgtcactaattaattgttttattctaaatatgaaatttagatatgggtgtaaaattcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttgttcctttctgaaaagtgaaaaacaacatcttaaagagtttcatttgtggtcttctcaaatcccatatcgaccatcaatggtaaatgttttttcttctcgtggtatcagtttttaaatatttttcaattcactgcaattcatctttttctttcaataagtgaaattcatgttacgtatttgtagaaaattacgtgattcctttcgatgaacctaacctcgttttgtgcagtgtttgatgtcactatttatggtgttggcttaatatcatccacaactcattcttgagaagatgggtttgatttgaaattatataaatcatgtgtatgtgtacacatctatattataataataattctttatggttacagattcactttgtgcttctcatcagtcgacaaggaaaagtaaggctcgcaaaatggtattcaccatactctcaaaaggagagatccaaggtacttatctctaattcaatataaaatgtaaatggtttaatctattttgacctaatgtgttagatcatggtagttacaattgcacaaatcattggatctgaaagtattcaatatggttttatcaccaaaattgcatgttgaatatgagctataagtatgaatctaaattatggcaaggcttcgatccttctacatttataatgttattttattatgagtgacccttgtttgatatttttaggcatatttcatgttatatcaattattaatgtttatgcatgttctgttaaatatatgcactggatcatattcttatagcggttaattgtcctatgaaatggattttgcttattgatgtcttttgggtatatatacaacattgcttaagtttttcttttaattctatttatgctttttgtctttattttatggaaggtaattcgtgagttaactggggtaattatctctcgagcccctaagctgtgcaacttcgtggagtggaggggattcaaagttgtttataaaaggtgggtcaagattgatcccttcattgttccctcagctgatgcatggctaacaaaatacactaaactataataattttaagagacttcattttggttattgtttagatatgctagcctatacttttgcatttgcaatgatcacgaagacaacgaattggagaccttggccattattcattactatgttgagacattggatcgttattttggcagtgttagtttcgtaaattgttgaattctaaagttattaataatttgcacacatacttcagatcctgagtttgtttctcttctcttaccaggtttgtgaactggatttaatctttaattttcataaggtaattcattttctctcagactgtattctttctaataatgcacacagttcaacaatattggataaccctcaaaaaaatcagataatctaatatcatgttacattatatagtttatacggtaaataagactaggatccttgcaggtttgattgcagtcttcattgtaatcaatcatattttcttatttttaatataaatttgaaagtcatatataagtaagaatgctaatgatttaatgaaagaaaagaaaactactatgtactattcggtgtttatcttaatccatgattaaaattgagcttgatcttggcaggcatactttatattggatgaacttttattggctggagccatgcaggagactagcaagagaactattctgagatggataagtgaacaggtaatttttcttattacattttccacttctagtttaccataactatcatattttggacaaaatctggtagtctttaatcacaatagagtctgattttgatcatttacattaggatttacactaaaactcaacataagttactaaagtgaaagtctaattgtagttaaagaatagcagcaaaaacaacaaaggaattgcatcttaattttatcctcatattttataattaatcttgtgttcatcttatgataatgagttacaggaggatttagtggaaactgccaaagaggaagccagctcattgagtaatataatcgctcaagctaccaagtaagagcatcactgaggattgaaattatgttacataggcagcacaaagttttcatgcgggtgaaaatttgttctatagaaaaatcattaaaaaaaactataataaatggttttattagttgtttattaatagagctacaatatgcatattaactcatatttgggttatacctagtgaataaatcttggttattattttattgagattgaaaacttatttttcggatgatgggtttttaaatgaaatggaaaaaatttataaatttggtaaaggattagatccgttgatatcttaatatttcatatagtttaattttagttatttttctcttcatcttctcctccttcttttcttcttctttgtttttaccttcttatttttcaacctcatcgtatatattattgggttcatttatcaccgacctcaattagtttgggttaaaggtgttgttgatgtgtattgaaaacttgtttatattcaattgtttctcactctatgattatttattgaaaatattatgcatctaatgatctcatttaaagtttaaatggtatactatattgtctagtaaaagcagcagaatttggtcacattctttggcatgcttaccatatcataggcatttctcataattctttagtagaacaaggcatgactaccttacatgaggtagtcagcatgcctagctaactcacaataaaagcacaggaagactacagaaaccaaacaatgaaaggaagaagacacgaaagaaagttaaactaaacaaactaagggcaaacacatgtgtggctatctgctagtttcagttgtgttccttattcatgaacatcttgagaatgccacatgcaaaagcatccctaggtatactcttcacgttttgaacagcctcagcaaaaatgacacccattcccatgtgcaaatgaggctcaatatggcaatggaaggcccaaactccaggattatctgccttaaacctcaaagcagtccaaccataagggaatatcactgcagtgttcctcaatggtgggttcttcaagttgaatttggactcgtcaccttgtttgaatttcccatcaccataccctaaaatccaaaagtcatgcccatgcaaatgccaagggtgaatctcactgtttttgcccttcattacattagcattttggagtatcacatcaacaacttggttaaactgaaacatgtaaaccccacttccaatgtttgcattagggttcaagggaggtttcaagatgtcataatccattgagaaattgtcaggtggactttttgggtcaaaggcaccattcacattaaacctaatggagcctaggtaaggagttgttggcaatgctagtgagacattgttaatggcccatttagtgtatccatcaacaaggttttgtgtgttgagaaggaaaagcctacgatcatagtgttgaggaggttgttccgttccctttagggcaagaattttgtaagtgaatgccttgctacgattataatcatcccattgaggtgtgatgggtggtgaagaagtgggaaaaactgaggcagagattgttttgtagtttaggatagttaaaccttgtggggtgttgggtggtcttcctctaacaccaactgaaatccaatagtttttctttgggtcttgatttgttgtaaggagaaccgagtaactttcaccagaatatatgtctatgtcatcaacgataaatggtttcacatagtttccatctgcttccaccaccaccaatttgtgattctataagcacaaagaagttaaaagcatgcaacacatgtcaatattcttcatgctgaaactaattacgtatatgcaactgcacatatacatattgaagtagagtttttacaaaagattatatatggattagtaagtataattcaatcatgacgtaaagtgcaaatgcatagctaggtaaccaactgtctaaatgatactagtatcaatttcaattctacatactaacacagaattttgttatctctgttttctcaccaaaacttcaatattaaattaaagattagaaaaatggatgaaatccaaagataataggcatttcgagtattcgataacagaaaaaaaagttatgccagatatataaaaccttttacccatttaatattttttttttttacagattttacccatttaacataataacttaaagttattaatagtgtgatatgattaatagataatagtatctcttgagctttttaaaaaaatattaataactaatttcttaatgttttgcaaaaaaattatatttaacgtggtattatggcctcctcaactataccgtgtgcatggcatatataaaacctttagtataaactttaattttaacagaaactaagtcctcgtaggcttgtacaattttattttttctttttctttttccccgatcgtcgtgcaatcaacaaaaattgaactttgtgtagtgtttgaaaagaagaagaaaaattgagagaaaaaaatatgaataaagatacttttttttattaagtgatgaagttttatagttcctcccaagtcccaaaactgaagaatccaaaggttaatccctgcaaccatgtgcccaaaggtatggggcctgtgcctgagccaggtagtaaaaatgacaagagctaccttttgtcttctctttcacgttcacgaccaatctacagagtacagcggcagtgacatctctatcatattttatggaaatattgttttgcaacatttattttttatttttcctagtcatcgaaaataaatacttggtttaaaaaaagtactagtttagttctccgagtattaaattcatattttataatttataagaataattttttatattatttaaggtttaatatattattaattatttagtttaaattttaataatggtatgttagtagatatgtaaaatataatttatacagtttttaagtactgtaatttgtttaaaattttataattgatttaagattctattgcaaatagaataaaataaatataaaaatttaaattaattgaattattaaattatttggagggaatgaatatgagatgttacataacattatcttatagaataatatatatatatatatataataaactagtagattttttagatttatatatataataaaaaataaatatatttatatataatatcaaatacagtattaattatttcatatttaaataataaaattccttattttaatttcattaagttggcatttttcatctccttttacttaccatcagattgtgtagaaaagaataaaaaatatataaactcacatttttagttgcttttataaataattatattatatattatactacataatacataaacatttttttttttttgcaaattcaagataagatgctgtatggaactcgggttattaaagttagcctactctgacatttttcatggacatatgcgtcgcatgcaggtttatatatagagtttgtcttgatattaataggcaaatgctaacttggttaagaaactagaaataaaaagttttctattgaattggtaataaaaagtattcaaaaaaatgtgttactagtattttatagtattgctaacaatattaaaaatagttaaaatataagactagttgttatccaaaacataaaatataaaactagcatgatgcatgctactaccaatataaatttcatgaaataaaatatacatatgataataaacttaccccaatggccaagttgagagatgccaaggaagtggtactagcaatcctgatcctgtaggtcttgtttggatcgacatggagaatctgaggtgcacattgttcgttacctctgaacttgcattggggcaaggaggtcttaataagattagctgccaaagaacaattgtattgtcctctcccattaataagcaaagactgaaaaagttaaatgtttgaaaggtaagaaaattctttccattcaaatatctattggctggaatcttgcataggtacaaaaataactaaaggaagtagtgtaggtggctttctttggttacttctacttctagagctattctcaccttgttactttatggagtgaattaaatattaaaagatatttaataggaaaaaatgaatattcttttatgtatgtgattgcaaatgagtatcactgtcgatcatcaagatttttaaatttttctaaaaattctagtgacactcataagtgaattgtcttcttcctaaaatgatttttttatacacatcaaacattattcgaccatgtgcttaagtcttagcccctagtcacttgaaccattgttggtaggacgaacatgtgaagatactattactgttaacaacattgtatctctcgcaataaaattcggtataaaattcggtataatggttataattaaaaactctgaataatatttgcaagtaacagtgaaataattacaatcatttaaaaaaaaatggtaacaataggaaagggaaaacggaaaactgaaacagacttttaaggccttacaaaaatcgctctacttataaatattagtttacattttatattcttcttcttcttcaattgtttagagattcatgcttttttgttgagttagtttttttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaataattattataaaacttaaccatcttactaaacatgagaattcttaattaaacaataatataaaaaatatgtatactatttctaaattctaatcaaattcttataaaattttgtgaccgggctattagacaaaatcgaatgggcgtatcccatgtttcttctataaaatagtataatttatatatgttttttctttcagaaatactaatagctagctttattttattatataaattcttgggacctctatatataagcacatgattaatagtatcttgaaaagctgatttggcaatggatttattgtttataaaaaaaagacacgtacgtagccatgcataaaataaagattatcgtgaacattagtgttaaaatctaattgtcttcttattggaaattccttaattacttaaaaagtaaatgaatttctggttgaaaattgaatatgttgatttagcaagggagaagacttgtttgcacaaaatccaatatttgcccacttccactagctggtccatttatgttttcttttttccttttgctcagcagggagagaaggacaatacatgtatgtgtttctagctaattcgtttcgaggttagattttgatctgcaatgaatttggatccatacgttcaagatatttcattatccatttttatattcttacatcacaagtgggagataagctgacatatgatatgtccttatacctcattaataatcctatgtttatttattcacataacaacatgagagaagaaaacaaaatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactatttcttttcatcccaacaaaatatttttcactttattcctcttttctttttatcatttctatttattttcttctaatgtatttcttctctatttcactgttaattcagatataagataatgaagagagaaaaaaaaaaacaaattacaatgacacaccactttagattttttcgtattacacacaatacttctcattttttaacgtttacaacaacttttcttacatgaatgttagtgtaataattgtcggtataatatttttttcaaacatttaaaggggttaaaacagaaataaactagaaaaagagtaatatcgtgtgtaattatatataaataaataaaaagttcagggtgttggagtatatataatttgctaaaaataaaatgatactgtgtgttttgttcgatttacctgaggttcgttaatccatctgaatggcatggaggagagaccaacctcttgagaatgtgtgcttttgtgccaccaatcactcagcaaaatgttgaactcaccatcataatggaatggctccttttttccctttggcaaattcactatcagagaaccatacagtcctgctgctctttgcataccaaagtgtccatgatagaaatatgtacccgcctgcaccacgtttaattttacccatggatattacaaaattaactcatatatattttgcatacattgaccatcatatgcataacacatccatgttttttaaaaaatgtaatatactgtaaaaaaaaattattaagtctgtttttgtaagtataacacatttttttaaataaaaaatagataagagatgcttttggtgtctcaaaatattaattttagtccatatagaaatttaataggttttcggcctctacttttatccaaaaacacatgtttttagttcctaattaaagactaattaaaatcatatcactttttgataattataggaactaaaattaatatttcaaaataaagataatgtaacatataccataagtatttatagctttttttttaagggataagtacttatagctagcacatgaaacaaaataaagagataaacgtaatttagtatgcaaataccctgtcaactgtaaatgtgtaattaaaagtttctccaggagcaatagcacactgtgaaatggcagcagttccatcagcccaaggtgttccatactgcaacatacacaatacaccccaaaaaagtgtacaagtttaatattcgatcatatttctatatgtatgtctagacagcgaaagaaaggaaaaaagtatatataaaacctgtctaattccatgccagtgaataactgttccctctgtggagagcttattggtgagtaaaatctcaagggtgtctccagcttcagctgtgatggttgggccaggaaactggccattgactcccatcacaacgtgctcatggcaatctggctcacgatacatgtactctacattaaacctaatgcggtgcattacagctcctagtgatagctgcaacaaagacagaaaaatgcaccataaggttatagctttaaagctcattatattgttattgcttttgctcatagctagagcctgaattgaattagaagaggaggaagttgtcaaggatttattagaagctgttgatctacaatgtaggttgtggcattatagggccttgcgagtgggtttgtatatatagagaaaggaggcaatacattatagagaggtagacttaatttatcacattcaacatgttgcaatgtggtatgttttcaacttgtgttataaatttttatttttattcttgaattaatctaaaaatatctcttatacaaatgttaattttataatattttatacaaaagggtaaagagataaatacaaaagaaagaaaaaaacatgtgataggttaaatagtatgataaagaatatatatatatatatatatatatatatatatatataaacatgatgtattttttgacatatttttgtcaaatattatcaacgtgtgcaccatcaattgcacataaggaaataacatatcatgtaagcacaaacattaacggtaccaaaggtcttttaaagataatagagtgaaagaattaattttactttaattttaaatttggatccataggtgcaagatatttcattttctatttttatataattaaatcacatgagggagattggtacatcaagaaagcatatgatatgccctttcactatatgccttaagagagaagaattacacgatgtatgttttgtttgatttaattgaggttcgttaacccatttgaaattctgaattgcttggaggagaggccaacttcttgcgtatgtgtgcttttgtctcactcatcaaacatcttccattaaagattacctaaaataacacccaagttataataatacacatctaaaatgagtctgacgtgacactaaagaaaatatacgctttacaaaaaaaactatggtaacgttaaattaacaagaaaataacatatttgggtaataagtgtttaggacgttaaatgcatgtttagtttcgagattattatttaaaaatcttaaaattgatataaaaaatatattttaaaataaaattaattaattacccacgtcttttgtatgtgaaataatttttcttggctacttgtggccattttgtataaaattgttttttatttatcgctcagagtccnnnnnnnnnnaatgaaaagctattaaccaaacacaatatacttgtttcaaattaagaagggagaaaactaattggcagatcttcgataatttagtttctaaagtatattatatatatttcataagagtaaactatcaatttgttctctcaagtattactttctcagcttctaaatggtctttaaagtaataaaattatataaataattctttcattaatttagtttatgcagtgatatattttactaacattcagaacataatttgaaagatttttcaatacttgacgggttgtataatatgatatataatacttaaaagattatttctatttttttttggtagcatgaaatattatttatgtattttatttagttcgagagtatggttatatttagtaaaattagttggtattcaataagattagttgttgaaataaataaaaagtgtaaaataaaaaaattatgatttatttaaaaagggtaattagaaaattaaatatatatattaaaaaattaaaaaaataaaaactagaggctatcattttgaaaaaagttaaattaaataacattttaaaaaacattaaattaagtaacattttaaaaaattatagaatctacttaaaaaaaaacttatttatcgaacagttaaacaaaattttcaattaataaaaaactaaaatatttaaccaaacataatctatatgagagaatgtactttataattgcaaccaaaaaataaaataatactttagaaatgaaattggtgttttattctattccaaaacaatttttcaaaagtattaatattataatgcaattaaaaacttagcctaacttcaaagtattaatattataatgcaattaaaaacttagcctaacttcaacaataactaaaaaagttgggacagattatatacttacatcatgatttaattacaaacattatcatatataataaatttattaactttaataattactataaaaatcatatatcagcagttttttttttattactaactaacagtgtttttacacttatgtacctagtcattacattttttttattactaattaacagtgtcattacacttatgtacctagtcattacactttataattatttagcagcacaggtaaatttcatagctttttggaaggaaaagagtattgtttaatattattcaaaatactatacaaagtcagcataacaacacatacccaaaaaatggtccatgtccattggtcatttatcaccagttgaagattaatctcttgtagtcgagttatgatttcagcctaaattaacatatctgtttgttaccaggggttcaaatttattgatacccaacatatgatggaattcatgttgtcagattatgattgtgatgcatatttatcattgctggaactatcgccaaattatattaacatgaatgacttaaaaacgtaaaagaggagacaaaaaaaatatgacaaaagtgtcagaagtgggatttgaacccacgccctctcacgaggaccagaacttgagtctggcgccttagaccactcggccatcctgacttttgatgtaagtgcgtaaaccacaatttatacttctattttatttaaataacaaaatttctctaaaatgcatttctataatttttttttatcaaattaaactacgctcaattataaattattgtaattgaataaaaatctgcaaaagtatagaaattatttttctttaacttgtaaacatagattgaatcacatctagaattgtataattaaaaattcggcattccatcctacaattgtttgattcacgttgaagtttctttgtgctcatgtgaaactagttctatttgaagcgttcataacttatgtacataggaccgatatcaacacgaagttttttatatgttttcgataagttttacaaaatttgtaatatttcgatacgttctcgatatgttttaatattaaataatatttttttatatagagtatatttcatattaataaaatataataaaaagaaaatcatcagcataaataatagattatccgtacaaaattaataaatacatcaactagtgtgtgaatatgaaggaagaataaacttcattctatttaggacacctttttttttaatttacaaaagtatcttttaaaaatatttgactaaaccgatacgtaaggtatcgatatctgacatgtatccgatacgttgaaattttttttttttctaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttataaataaataaggtatcagagcatacatttgacaaaaatgaaaaataagtgagaagaacaatgaataaaaagaaggatggaaaagattgacatttttaatttaaggtcttgttaactagtatcaacattaattaaaaaaagaatatttattatataatttataagaaaacataaaaaagatcattgatagtacatttttccatctcacaacaaaatcatttatattttatgtttcttaatcaatacactggttaacatttatcttcaatttaaccaattcaaaaccaagtaaaatatggggctcttttttagttaacaagggagatgatgcaattatgtcttaaaaccactgtgtttctttaatgacgtgattcaagcatgatataaatagaacatcaaatgctccaaattttccgacgacgaattataacatcgagtactctaatggtgagttgtttgaaaaatatacaatacaaatagtctagccaaaaacaatgagcttatttgttccgtagttaattgccaattgaagccaacaatacattcagaattcagaaggtaagaccaattcatttgaaaaccagaaaaccattcccccaaaattaattattacacctccagtgttgtttaaaatgatatttaaaattctgagtggttaactcgaaccatcaaaaggtaacacaagattcctatctgtgggtcttgtttgccattttcattgcatcctttgcttgataagtgcaccttttaaatggaacaagatatatattcctaataacttgaaccaatttgttaagcaaaagtcaagaggattaagctcagttaattgaataaagatgcaaaaattattataaatcttctaatttgtctttggttattacggataaaaaaataactcgaaccagtttgttacccgtcaattaacgagggataagccatctttaaagaatttgtctccttgcacacgatattcagtgacatcaagcaaaagttacatatgtgaagtgaataccacgacgataaacacatgcattgtcattgacaaagaaacaaaataacaaagaatggagagcaatacgtcacacatattttatcagagtgactaagtcgatttttttcccctagtatttcatcaatagatattcaagtctcaacatcattgtcagatcataatattgttacaaattccaatgcccttcagtatgtaaatttacatataccagagattacatttaccactgcccattacactatgaggtaacacttaaaattttagaatacatatatataattcaacgcagattgagatcctaccacatcacgttattcacgagcagtttgtatcataacttacaagtcccaacaactctggaccttccaaacgaggattattctcaaagctacagcattgaaacaaaacaacgcttattcaacaagtaacaggaaagaagaaagataaccagatagcagaaaatattttcaagctaaaatctagaaggcaaaatttaaatgattacagaatcagtgcaccagaaaaatgcaagaagaccaagtataattaactgtataggacaataaaatgcaatcaaattccctgtcatcacaaatacattgtaccagggaagcctcccaaaagctgtgtcaattcctactatcccatgaaacaattggaaattgcctatcacatacactttgtgtcatcatcacacacaacaacgaataacaatcaaatattatcatcacaatttaaacaggacctccataagtatgacgtgaacaggacacccacaacatcttaaccattaagcaataaaaattgcaagcgtgatatagcagcatttagcagcgaaggttactaaatttctcattgttacccccttccctcccccaaggccccaacaaaaaaagaaaaagaaaaggaaggaacaatattaaaaaaaggtgcagaagagaagaaaataagactcgagtgaaagccaacatgaatagcaccacatggagaataagaaaaaagctacatgcttagagttaagaagaaattacttattcaatggaatatgctcgaatggcccggaggtaggaattgtaccacataaatcattgttggagacatccctgaaaataaagtgaatgtttaggctctttgaaagcataaatcttcacgataccaccaaataatgttatcatgatcaacatataaagacaagattgttacttacactactttaaggcttgaaacagcagcaagttccttggggattgggccagttagtcggttgtcattgagtcgtctgcaaagaaaacacagttgagagaattatgaaagtgctgaatatttattccacaaaataataatcaaaagtctcaccatatcatattgaaacactaacagcttccaacacttcaaaatgggattactaactcagattaatatttattaatgttattttaaattgtcacttagcttccaggtttggctgaataaatttcagactctgggaaagctaaaagctaggttgaagtattttaccacctaaaaaaggtaaatagctttctatgggtcattcactgactagaggtttgataaggatattgaattgtgcttagacatggtccattgaaatgtttagatagagcttttaagtttgtttagaattgaatcataccactgaatgttgggactgaagtcatctcaatttaatcaaaatgagtcatactagaatagtaaaatcactctttcactcaattatggtgggggggatttaaggggagaaatttttcacactgattggactaaattatgctttacttaatggcttcatttgtctactattttaaggatatgatagtaaattattttatttcctttgaactaaaacactctgttgatatttcctcctatgaatgaggtttatatttgggtttgagcatgtgaattttgaaagaaattcatttcatatctactgtcataattcatctgtcttaacatcaatatatgccctacagtcaacatcttaacaccaagcacaaaacccaaaattgtccatgcccaaacttaatataaaatgtagtcgataagttgctaaccaaaggttcttgtactatgcctgcatcattcaaagtcttgtaagaaattcaaatgaaagaagggaaagcaaatgccacagatctgtccagtcaagcttaatatgttattaaacatacttacaaaaagacaagattcttcaatttccccaatgaaggtgggatggtgcctgatatgttgttgttgtacaagtccaagctaactagactcttcaggtttccaagttccggaggagtagttccttgaatgttgtttttgtacaactcactacatccaatgaaaggaaaaccacattaaacactaacaagtataaaattctatagttcacaacaataagagagccacagcatataccaataaatcaatcattttagtaataatatgagcacaatatgaaacagtgtcttatactttcatttgttttacgtctacgatacatatccaaaaccaatactcttggatacttcaccaacacatatctatgaagtatccaagccttttaaaaaaagtcatgaaaatataatctactatagctacatatcaaacttcaaacataatatagaaacatagaagcattgttccttaatgaagcaaaaaatgaaattgtcctctttatggatgatttcaagagaggaatgagattgatatcattcctacttatagacaatagaaagtgatttatgatgacaatgctttatagtttttattttattcatagtaatgtccaagaagtgtgttcttaatttggatttgcaattatatgtttattatgttttatgaatttttatacatatctacaattctagatattcatctttcacatattgtatctaatatattttatgtatcagatgttgatggaggtccacatacatcagatgtttattatgttctatgaatttttgtacatatctaccattctagatattcatctttcacatattgtatctgatatattttatgtatcagatatttactaattgtatcgccgtatcggatatgttttgtatttgatacatgcattgtactatgcatcataagagcataaataacaaacttaaagtcctctttattcctatttgacaacagaaagtgatttatgatgacaatggtttacaatttttattttgttcataagtatcttaacgtaccatatctgatatatttttaggataaccgcattaacgtaccatatctgatacatgtattgtgtcaatgcatcataagggcacatttaacagacttaaaaagtcacaatatctggaaaaaaatgtaaagcgaagttagaaaacatacagatactgtagatgctccagcttcccaagttcaggtaccaaatgtccagataggttagagttaccaagatccctgtagaaagcaccataattaccataaacatggagagaatattaacagattcagtcaattcaacacattttagttagcatttcagcgagccctggcacagcgttaaagttgtgccttggtgacttgttggtcatggattcaaatctggaaacagtctctttgcatatgcaagagtaaagctgcgtacaatatctcttctacttatcttcgcataacgagaagcctctaggcgatagggtacgtagttttttatccttatcctatttgatacatttccgaatccaatactcatagataattcaccaatacaaatatgtgaactatgaagtatccaagcctttaaaaaaagaaatgaaaatcaaatatagctatatatgagacatagaactgatagaagcctgtatacagtgtaatacagaaacatgaatttcacttgcatattttaaattgtttatgcatatctagatatgcatctcacacatattacatcctacatatttttaaaaataattgcatgagttgaatttcaatttctatgtattgtcaatcaatcaaaaatcattgttggcataacttttagggtaattattttaaaagtcaacaaaatttccatatatgactatttactctatgtatctatatacatatcgtatcaatgtatcgtatcataagcaacaataatcccccgtccagaaaatcaaacatctaatttaaaatacataaaaaagaatcccagtgatggagaacataagaaagtatctaaagacaacttttaatggcatgtataatttgacgattcccgcaacctcgcggaggatccttcaatttcataagcaattaacaaaataacaaacctcgctaaaaatctaaaatcagcaagcaccgcgtaataataaaactgatagcagcagtataaataaattaaagtaacatatagtaacaattaagaaagcaacaaaacacaaacacacacagagagagagagagagagagagagagaggatgcatacactcgagtgactcggttgtcctggttgcaggtgacgtggaaccaagtacaggggctaacgagagtgggatcccagctctggaggacgttgtcagggtccgagaggctccgtttcagcgtgtagagagcgtcgccttcggaatttgaggcggcgaggtgagcgagagttagggttacggagacggagaggaggaaccgcagagaagtgcgagttgctactgccatcgctgatctgagcttcaaccgaacacctctcgttgccgccgtgttagggttcactagcggtgagctcttattggaggaggatgcagcaatcgcgctgcaacgaagaaagaaagaagcagagggaggaggaagttctagagagagagagagacaagggagagggaagaatcttattatggagagagagagagaaaaagacttgaaaaggaagtatcggctttgggaataacacatagcagtaaaacatggcatgctcgccctcgcttcatttttataacttccttccattataattgttatatataaaagaaaaaaaaattatattccttaacattaattaattatatttttttattatttacatctcttataatattaataataaaatttgtaaataaattaatagtaatataaaattaatattattttatttattaaatatttttaatctatataaaataatttaggacgaatgttattttgaaataaataaaatatttagtttttcaaatgagtttttatatcttcaattaattcaaaattaattttgattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaattaactaatggaaaatttatttttacttatagagaaacttatctcatctttttccttttattttcttcttctaaaagtatttataaaaaaatttatccaaatatctcctaaaaacgaaacagatgtgaaaaagaattaggaagaaaagtggcatattgtgtgtgcaaagtagagtacattttggtaagtggcgtattttgtgtgataatgctaagtttgtgcaaccaccattactgacacaacctaaagtggttgggagaatccaaattggtttaattattttatggctgtggtgttacatcctcacttttgtcaacgcatccatttatcttataatcctctttttatttatatgaaggataccctcatctttctatctcaggtgtattggttaagtctataaaaatagaacactgtgtaacaactatttattatgtcagaaacatacaaatcacttcaagtaattgaaaattgttaaaaacggtatctgatggagtataaagaaaaaataatctaaataaccatataaaactagttaatattatattttataaaataaaataaaaggctaacttctttacaaaattattttgtatattgtagccttggaaatatgatattttcatatttgatacgtgtctctctaaacattttaaataaaatatcagaagttaaataaagttaataaaaaaaaagtgaaacaacataaaagtagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtatgaatctaactttttaaaaaatgaaatatctgatttaaatttatttatttaattttaaaaccaaataagtataaacaaagtatgtacttttaattacagctaaatttatcacgtatgcatattttgtttagaattttaaacatattcatgtattgtcaatttttatgtatcttttcaaagtaaataaaaaataacgttgtagtaaaaaagttgtacctgctgctagttaaatgaacatgatttctaggataaaaaaaaccaattattattatttttgcacattgatgtctccccaaaattcatttattcgcacccccagcattatccacaccaaatgctacgaacgtgaatacaaaaaggcattttatcgaaagaatcgatgtttctctttattaaaaaaaaaaaaaaaaaagtagtaacaaatgctgagggaaatggggcccactagtgcaaacgtaatgaccatgctccacctttacgaaccgaatcccaaaccgtcatcaaattttgcctagaaacgtgatcggatctcagccctccacgtcatcacaccacacctcatcatcaaacgtccgagagcgggtaacagcacaaactgcatagagcgtcacagcagagtgcgtcatttatttttactcttcgtagtcccccagaggaatgagaggatgcgaaccggtgcacattcactctcgctgctgccgctattaaaagagtgaagggagcgagtcatagaatcacgcttcaaatcatttgcattcatttttcttctctctgcttcttctgcgccattttagggtttgggtttgtgcttgctgcttgcttctgtcactgattttctggtgaggaaaacgcctactcttcttacctcattaattttgcttcgttttttcgttgctatctgtcatgatcacatgctgcatttgccattttctgcgtttttcttccgcttatttcgtcctcagtgcttgtttcaccgtttaatcctggcctattgatggtttagcgttttctgctttcgaaatgcttcactgtagtttatgttctttcattttcctgcgtttttttttttgtaatgttttgttttgctgcatgtgtttcggctttgatcgtctttttttgcatgtttattttgaagaggaaacgctttcgctgtgcttcgttgaatttgagctcgtttttgcttccgaggagaagcttgtttgttagaatcttcagtgcttttttgagtttaattctagcggtttcattggttgtgatttgcctgtgtcgttgtttttttttttttttttgcttttttaatttttatttttaaattctacagagtttaataaaattaatttttcagagtgttttgagtttactccgtgctttttcactgcttgtgatttagccgtaacattttttttgcttttactttttttgaaagcgaaaagccgaaaactctgtttgctctgatgatggtccgaatcggtgaccacacctacttatttttgggcatttgtgttccgaagccagatatttgcttcagggtacctgattttggcctccgagtatcttttttgtgtttagttgtatttattgtttaatttcgtttgtatttgtattttatttttttataaattttacttgttttagctttttacgtcctccgtgctgatgtcgtttactgcacttttgtgtattttattttgcttgcagtgcatgtgattatttctatgttggtttatttgtataaaatgcgttttgctggttacttgtttgtttcatcaatttgagttagaaatgttgttctagattctatattctccccttgtaaatctatgattattttgctgtttatgatagttgttcctttttcattttgttgtgcgaaaatgttttactatattgtttttcgcatgattagaatttttatgtagataatttatcagtattttgttgcttttaaacttcttttctcagtaggtttatttgtataaacgcattttgttgtttgtttgccttttacgcttcctgtttgagtaataaatattactctaggtttttgtttcccccctcttaaattgatgtttatttttcagttttatttgcatgatagcggtttgtctcttattttttttgtatgaaaatttgttgtaccatagtgttggcgtctgcttagatatgcatgtggacaatctcacaatatttagttatttttcaaattttttgttcgaaggaatatgtgaagtaactacttatgttgacacaatttatttaatgcatgaactatgcagtagatggcttctttcgggccaaatggaactgagaatgaggattcgttgcctcccccacctcccgttgtaccatcagatgttgtacctgttaaagctgagctggagaagaaaaaggcttcaaggtttccaatagccaggcgtggccttgcttcaaaagggacaaagctacaactgctcaccaatcactacagagtgaacgttgcaaacactgatgggcatttttatcagtatagtgtatgtgctttcattttcacctgcattatttatttcaggtctctgtttaacttggaatcatttattcaatgtttatgtttgaacaggttgctcttttttatgatgatggacgacctgtggagggtaagggtgtagggaggaagcttctcgacagggtgcatgaaacgtatgattctgaattgaatgggaaggattttgcgtatgatggtgagaagactctgtttactctcgggtctcttgctcgcaacaagcttgagtttacggttgttctggaggatgttattgctaccaggttcaaattctgtggatgctaattcttcaatttgacttaactttttactgtttcagctttgtaacttttttttttctgtaccaatgtatgttatagaaacaatggaaactgcagcccagagggcaatgaagaactgaatgagagtgacaaaaagaggatgaggcgccctaatagatccaagacatttaaagttgagcttagctatgcttcaaagattccattgcaagccattgccaatgctctacgtggacaggaatctgagaattatcaagaagcaataagagtgcttgatatcattttgaggcaacatgctgctaagcagtgcgtggattatgatcatttcttttttcttctattattattattattgataacattattgtatcagcttgcctttgtgtgtctcttatgttgtaatttaaaataataaaataatgtcaatttgcagagggtgtttgcttgtgcggcaatcgttctttcacaatgatcccaggaattttgctgatgtaggaggaggtgtacttggttgcaggggcttccactctagttttagaactactcaaagtggactgtctttgaacataggtttgatctgttgtttgccttggacactacatttgtttcctcataatttttattaattctgtcttgcaatatgtttagatgtctcaaccaccatgtaattacccctgggcctgtggttgacttcctaatatccaatcaaaatgtgagagaccccttttcacttgattgggcaaaggtaagctaattcaatgaccatttgatcatagtacttgattgattgccaaatacaataatctcatcttttatttattttcttgaacaggccaagaggacattaaaaaacctgaggattaaatcgagcccatctaatcaagaatttaaaatcactgggcttagtgaactcccttgcaaagaccaaacgtatgtcattaattctgcttttgttcttgataattaattattattaattttagagatttttaattatcagggttagggtgttgtaggtttacattgaagaaaaaaggtggtgttgatgttactgaggaagaagtgacggtatatgattattttgttaatattcgcaagatagatcttcggtattctggggatctcccatgtatcaacgttgggaaaccaaaaaggccaacttacatccctcttgaggtagatttggtgctttatatgtttgttcaggactttgaattagaatttctttgctgcttaataactttttaactttttatgcttagctgtgttgtttggtatcacttcaacgttatacaaaagcactatccacacttcaaaggtcttcattggtggagaagtccaggcagaagccacaggagaggatgagggtcttgtctgatgtatgtgtctttttgtccagttttgaatatttgggttgtatattttctggtttacctgatgttactttaattgttacaggcacttaaaagtagcaattatggttctgaaccaatgctacgcaattgtggaatctctataagccccaactttactgaagttgagggtcgggttttacaagctccacgggtaaattttaagtcattgtaattgtgcatgtgcttattcatttttatcatgtattgtctgctatatcttcatttaaatagactgttagcgaatattgatgaatattgtggtggtgacttaattttgttaatattgtgctcagagaggtgtagctttaaatattgctttgcttaattgtctaagaatagttggtaatataatcttcatgttctaccgtaaccaattctagttggttttgtatggaaatgtttgtcaaattattaagatgtagttttatttgttgttgatggcatcttgttcgttaattatcaatgttgtgttctgtaatatgggtttcaaagctgattattaaatttttgtttgtagttgaaatttggtaatggggaggacttcaatcctagaaatgggaggtggaacttcaataacaaggtatgtcattctaatcttgtattaatttcataaaaaaatgatttgaattttctaataattgaatttttttctccagaaaattgtcaagccaactaaaatagaaagatgggctgttgttaacttctctgctcgctgtgatgtacgaggacttgtgagggatctcattaagtgtggtggaatgaaaggcattgtaagttttataactgcagattgactctgaagcataataaggtgctgactatatttttcttaactgcaattggtaggtgatagatcagccgtttgatgtgtttgaagaaaatggtcagtttaggcgtgcaccgccggtggttcgagttgagaagatgtttgagttggtccagtctaaacttcctggggctcctcagtttcttctttgtctgcttcctgagaggaaaaattctgatctttatggtaagttatttgataagttttgtcttttgtttactcctttcatgcaattgtttaagtccccttattgatgaaaattaactgaacttggtaaggtccatggaagaagaagaatcttgctgattttggaattgtgactcagtgtatagctccgacaagggtcaatgaccaatatttgactaatgttctgttgaaaatcaatgctaaggtatgttgtttcttggtttaattttctatttttttggaatatatattgtaattctttttgttcagtttgtcgggattcattgttgtacctgtcattaaattttttattgttttgtagcttggtggtctgaactcaatgttaggtgttgagcattctccttctattcctattgtttctagagcgccaaccatcattattggcatggatgtgtctcatggttcaccagggcaaacagatattccttcaattgctgcggtattttaattagtgcttgttatgtgatttttatattgggcatctgtttcaaacctatgattgtcttagtttgagcctacttcctggttattggaatgttttatgactatctgattatatgctaatgcttaaacattcaggtggtcagctctagagaatggcctctagtatcaaagtatagggccagcgtccgtacgcagtctccgaagatggaaatgattgataatttgttcaagaaagtttccgacaaggaggatgaaggcataatgaggttaatttaattttgtatcaaatcattgaattaatcctcctagtatatttatgatatcatattgttctcaattttttttaacattaattttgaatttggttatgtgaaatgatcagaatttggtttctaaatttaagtgaatgccagtttagttgcaattttataaattataaacagttttttgtggtacctgtttattttgtggtttgtattttttggaattggacggtcattggtgtgttgtatatctgcagggagcttctacttgatttctatacaagttctgggaatagaaagcccgataatataatcatattcaggttactttttttctcattttattctgtgtaatatgtactttatttttagtttttataaatttttttgagttgtgtgtgtgtgtgtgtatattgttgttagtctgttatctagtattgtggtggttaatatgtatggcagtttgtgtaatagttgattagtttaaaagggacttgattgatggtcttttttagtgttttgaatgataaagttgtatgatacgatccttgttatctgttctgcaaatctctttttatgtcaccaagacaaatgtcaaaagcttatagatttaacaaatgcttctgtttagtttgcaaatcctgacctattttatgttagatgatcagttgttggacctataatgtgtatgttgttatatgtgtatgtgtgtactgaattgtatatattttttaaaaaaaaattatttgtctttggccttttttatgtctattattttattagttcttacatattttttcataatgaatctttttaatttgtattgttagttaagtgacctttttgtgtattttgaactgacctttttttggctggatgtagggatggtgttagtgagtcccagttcaatcaagttttgaacattgaacttgatcaaattatcgaggtgcttatttattgagctgatgaatttaaattttaaatatttgaagtgtttttggggttaatattgtcttctttaatattaggcttgcaagtttttagatgaaaagtggaatcccaagtttttggtgattgttgctcaaaagaaccatcatactaaattctttcaacctggagctcctgacaatgttcctcctggtatgcatcttgtttattttgaattttaacacgtttcaataatttttgttttgttatttctttactcttttatttttgcaggaactgtaattgataacaaaatttgccatcctcggaattatgatttctacatgtgtgcacatgctggaatgattgtgagtatctgctattttttttaatgtggttttggttttacaatttgtagttccattattgtggctcctatccttttgttgatgtaaagtgcacaaatgttctttaagacgcatgtacattcatttcacatggtgaaattgtttccaaattgaagtcgaaggtttctggcttctttccttcttaatttaatgtttatgtatgttcatttgcatgcctctattttttaatatgttagtttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttctgatcatcctcgttattcatttcactgaatactgtttatttagagagtaggaacccctttgtacgagttttccataaatgatatgtttgtgtcagaacttcaataacatgcttgtatttctttgaaaaattactattcagggtactagcaggcctacacactaccatgttctgttagacgagattggcttttcacctgatgatctacaggagcttgtgcattcattatcatatgtgtaagtagtagttgtgatctatttgattgttttagaatattgtttatgccaacccttgccatatatcgatattgtcttaaaatcattttgctatttgacaataggtatcagaggagcacaactgccatttctgtcggtaagttcttgcacaacatttttagcattgtgtttacacttttatgttcccaatttatagaaatatatagggtctcattggtgaaaaaactggatgtatgcagttgctccaatatgctatgctcatctggctgcaacacagatgggtcagtttatgaaatttgaggacaaatctgagacatcttcaagtcatggtggttctggtatgcctgctcctcccgtccctcagttgccaagattgcaggataaggtttcgagctcaatgttcttttgttgaaggatctattgcagttctagggataggcgatgactgataacagtgctgtttataagaccttcataggatttttttatttttttttgtggaaacagtttaactatgggcgccaatggtagtaggaaaggattattatacatgtaagaaggcattttgctcatgcctttacatgtattttgaatattgttgcgaagtctttcgctattttgaagattgttaaggtttatgtgattcctatggtgttcctattatgcactcttgatcattatctaatctagttgtggtttgcatgaatcaaaaagatcaaatgggtattactgttcttgttaaagtttgtttgtgatctgtctgttatttacggataaaatccatattttcgactcctgatagcaatgtgacccgagttaataagaatgtctcagttgtgttaaaaataggtatattttcatcaggattttgagatcaatgctagttacgtgagtttaacttggttatttatttttccgcagttaagttattttcttttattctggtcgtttaaattacatagaaattggaacattcatgcagtatccacagaagaaaaaaaattgccttctatttgaaccgaatgagaaagttaaagtatatagaagttttatacagtttgaccaatattctattattcagttcagtttagatttttgtgttattctttaggatatatatttctttttgtataaaacagttttattttttgttccatgatatttttttcatctttattcttcattctgctgataatctaaactgaaatattaagtttaattaaaaattaagttgactatttcaaattcttttttagaatatgaacatttttttaatagaaatttacttttttaattaacttttaaaggtacttgaatcaatatgatgtttctgccaaaaatatcaacatgacagttttttagaatatcaacatttttacatgttaaagttaatttgttcgtgctttttgtaagtaaaaattctgcaaaaaaatatcaacattcatatgaaatttacatgtgttaagaggcaagctaatgctatggctcattctaggctaaagctaggtttccagtacattccatcgtgtattcttcactagcctattaatgaaatgcatgatttagttctcgtaaaaagtcaaaatcaatatgaatgttgtatatacctctttcatgatttcctattgacagatatgagtgacattaattcttgaaaatgataaatatgggtagcatttaagaatcttaaaaatggagatagaatttttgcattttctctaatattttttaaaaatcaattttaaaattactttgtgaacaataattaacaatgcatgtatcatagagaaaaaaattgatgacgtgaagagttacattgacataaaataagttggatatactcaacctctaaaaatgaaaaaaaaaatatttaaaaaaatttaatttattttgtaaaaatttaaaagtaattccttattttttcttatttacctgtgtggtgcatctttccgtttcgttgaatcctgatccgtaaaaaaactaggctccataaaacttatcagtttttgacaaacatagtgcatgagaccaataatcccttgacaacagcaccctataattctgcttgtgttaatatccctccaagagcaatgaacccataccattgaccaatgtacactgtttcccgtgctgctcaaacgcccaccagctgtttgacctaagtccatgccaccagttacttcaagaaaccacatctaccagttgtgggaatattaagttgcactttacttgatttacagttagtgggggaccacatcatggccttgttttgttgatttgaacccttgcaagaatgctcataagaaatttacattgtcacaaagtccattctctgagcctaaggtgctttacttctgcaactcctaatgtacttaagcctggggatgtcttgagaaaagcaagggtttatactgaggaagatgttctccaatactccaaggtgagttgtgattctaatcctttgcatactgattctgctgctgccaaagatgttggatttgaaggtccactggtacatgggatgcttgtggcttctctctttcctcatatcatctcatcacattttgtaagtttcatacttaccctctctttaaattttgatatgcctcctaaaatgagatagttaacgttctcatctcaatattaaattaatgtgaataaacagataaattagtagagttctattattagttttctagactgaattttatactctgttctctgtagcatacatttttacatgtaaaagttaatttgtttgtgctttttgtaagtgtgaaatttctgccacagtcagcagctttggggaactctaagttgattctgggtccaaatccccttgcccccatgaacatcctttctgtaaacttgagtattagacaccataatggaaaattatgacatgagatagagtatcataaaatgaagacggataagatatgaaattgtaatctccactataaggagtgtgaaataaggtcaagtgacccctcacttattgcatagattaaaatgtgtcatgattaatcagaagtagaaagggagacacatgtaaaaagcttaaattttatagtatttctgaaagacatgaaaatataaacatggataaaggacttatcgtgtgtctggattggcattatgtcagtgtgatccgcgtccttttgaagtaaatttttttagcttccacattaacttggcatacttgacgtgaatttggttttggatgtggttggaaaatgcaaatcaccaacatgctattaagtggtcaatttaaatgctaacatgggttctagttctactgcttgaaaaattggtacttgtcattggatttggtcaacttgaataaaagacttgattttaaagtgcttgataaatgatgtgaattgaggcaatgctatgaagtcattcattgaaatattctcattctgtgataactttcttaaattcctcttcttccctggccacttcaatcttcaataattgcagcctggagctgtgtatgtatctcaaaacttgaattttaagttcccaatctatattgagatcagattattggtgaagtgcaagcaactaatctgagagaaaataaaaatcgatatctgtaagtttagtcctgctgttattattgtgcattcttttttaaacaaggagtaattttgtttctaaatgaatgtttctcaatgctattcagtgcaaagtttaagacaaggtgtttcaagaatgatgaccttcttgtgattgatggtgaggctgtggctttgttaccaaccttgactgtagaacagattcaacacgagaagccgtaaaagatattcactgttcttgactgttaatcgcaaataccttttcaaaggcaatgttggtcataaaagtaatatgtttgttgttttctttctaatggaagtcattggggttctaaattctaatcccctaccctgaacacggacaaacagcagacaccaaaaaagtttttgttctctttgttattctgatgttggtgctgaacagttatgtttgattttttgtgtgcttttttatcatatcacgcaaaagttcacttcattgcactgagcttcaaatcaaacggcacaaagagatcttattgatatttttttttgtcttttgtgccatctaatactattggttttggaggaaatgtttaatgtagtaacaagttagattttactttgtttcgtgcccatacggtttctctatattttgtattggcaactgcctcgcatgaaatcaaaaaatatggtcccttattaatcctgttgttcttccctctatagggttcatttaaatccaacatttgcagtagctatttacacaaaactaatggaaaatttgctttgttggtaagttttaagtaatagcacatgatccaaaattgttgatttgttaaaaacgaaaaaaaaaacattaaaattagttcatgataaacaatctctcttccctttttttcttttatctttttctcaagtaataatgtttggcattactattataatagtagtatgtgcgaataaattctttatttatttttgtgtacgatagcgggacaatgaaatttgaacttacaacttcatataaactatctagaccacaccactaggccaaacaatttattagtaaatttaaaagataccttgaattccatagtttaacttaccatcacacaaagtaaaatcaatacaacaattacaactggtgcaatagtacatatggcctatcatttctagtaactggtgttatcagaagagatatcccacatcaagacaaagattaacaccaaaggtatttggttgacttgaatgccatctgaagcacaaccactttctggtgaaggtgctggagcaccactttctggtgaacttgctggagcaccaccttttggtgaaggtgctggagtgggtgcagcaacaccttcagtaacagatatagcaaccttcatcccatgccaacaatagcctcctccacttaagaatagtaggtcttgaattcagttagatgaaacacgtctcttcttgcaccccttgatatgttatgaacaaatcctgtgtccatgtaattctcataactaagccttgttcacctctagtacattgtactcgttcctatcatatccaaagtcttgcaagcataacaacatctaagtcatagtcaaaagataaagtataataatctacattaataaattaatctacaattatatgtgccctttttaatgacttggactcctttttctcgcttctacattaataaatttagtaaataattaaaaaaaaatatttactaaatatattgttgtaattacgaattcaagaacttgccgcaaactaaaaaagcttagaaaaattgaaatataagttaaatttaaagaaaaactaaaatattttaaaatgaatttccttcaaatatattatttacttatttcaataatgttattctatttaatgtaatgataatataaaaaataatatttttaattttagaaaatatattatttaaaaacatgtaagacctcacaacaaactacataaccaaattggttagatttggttaatgacctattctaattaattgtatactagtgatcatttgttaattgataaaatttaaaaataatattttatattaaattactcaatttggttagataatcttgggtaggttagttaggaaatccattaattaaaatgtattattttgattctttatgttttttaaatgtatcattttgattattttaaatttaaaaattaatgaaatattaacgttttaaatgaaaaattgaaagaatgatcaaaacaatatatttcaaaaacataaaagaataaaataaaatttttaaaacttgatatatcaaagtaaaataattgtggacataatgaactaaagaggaaaacgaaaaaacaacacgtgattgaaaataattatttttctgaaaactctctttaaaaaacagcaatagaaaagtaattccaaagaggaaacaagtgggttggttgtcagcggtgaacttagacatgcagtgggtgcacaccacaagcgcaatatcagaggaaggaagcatgcactgcatgcatgtacctacccttttcaattcaattatgcatcattctatcattctacgtctctctctctctctctctctctctctatatatatatatatatatatatataattatccactcttcattggatgcaaggcaagccgtggtggttgtggaggtaccaaagttgggaaaagaggctgcaactaaggcgatcgatcaaggaatggggtcaacccaagtccaagactacccatctcatcttttgcaccaccagcggtgtcgaaatgcctagctttacatgatgtaccaacaaggctattgtttggagatggtgcaccatccttccatacagttggactcactttccatcccctcaaggatgttcctggactcatctctaagaatatcgaaaaggcactagtgtaagcctgaaaaaatggaagctactagacatttgctcagcgagtatggtaatatgtcaagtgcatgtgtgctattcatcttggatcagatgagatgaggaagaagtctttaaaatttattataaaaaatacaagtttacttttccttttaagaatgaaatggattgtaatattattactaaaagttggtcacgacctgcacatcaaagtcaataaaagaaagtaattgatgagaaaattccaatatctaatccatgtacaaatatcaaaatccctaattacttgataagttcactactcttacaccttacaccagaccacaacctatgctaggattaaagaatcatactactacggtgaaaatattacagatagtacagcttccagcaagccttgtattccaatgtggtcatcaccatattcaaatccactaagttgaagagtcgggctgtttgatgaattcacatgcaatatttgttgattttcatgaacttgttgatatgcagaatcaaatccactcatttgatgagtcacgctatttggtggattcagcggcaacttttgttttttttgttgcatttcgtgaacttgttgaattccagtaagaggaattgaattttgtggatcaatgatgtgaggaactccatttgtgtaatgtaagtttttatcatgaatgctttttctttttttctgcatgggtgaggcattttggcgaatgaaatacttttgggcatgactggcaatttgagtaggggatcttgttttaaccaaccttgatatttctatccagtttcccttcccatgtttttggagcccaagtaaaaacaacctgccattaaaaaacaaatatgagaggaaaaatcgagaaacttccattcatttgatttctatacaatatattaaaaacctacctatgttcttcttcagtccatgtattccttctcccttgcttgcgccgaaccgatgaaccagcgttctgcatcatggaaccaccaccgttatgcaccagcgcctcaactgggtggctgggcaactcgaccggagcccacgcaatctggttcacgtgattgggcaatgtctggtggtgttgggtgtcctccgcaactagggttgcaacgttcagcggtgtctggtggtgttgggtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacctgggtagcaacgttcagcggtgtctggtggtgttgggtgtcctccgcaaccagggtagcaacgttcagcggtgtgcggtggtgttgggtgtcctccgcaacctgggtagcaacgttcagcggtgtctggtggtgttgggtgtcctccgcaactagggttgcaatgttcagcggtgtgtggtggtgttgggtgtcctccgccataggaatctgggtagcaaagttcagcgtcgaccatatatcatcgcaatcaaaaagcagattgtagtcataaacatcatcattccaatcgttattatagaactcagacattgttttcttcttttatggctttcaaagtttgaagctgcaaactcaaaatgcctttctttccgttcacagggcttcttatttaacaaagcatgacgcgctaaaatttggcgcccaagtgacactcattattctttaaaatttgaaaaaaaaaaaattctttcaaagttgcttacccaaagatttcaaaattattaatcataataaatttacttatccaaataaatgagaaattatagtaatacatttttaaaaagttattttaaacacaatatttattattagttaaaatttattagaggtcacaaattttatgatcctacttctcatttaaaaactttttttcaattttataggttttaataaattttaactaatattacttatgtgttataaatagtgtgttaatattacttatgtgttataaatagtgtgttagggagtatattattaacatttctctaaataatatacataatatattattatataaattttatcatcatcttttcaaattatatgtttattaatttattaaagtttaaatttacataattatattaattaacttatttataagtaatttcataattttatttgttaatattatcactaaaaagtgagattttaaataattttttaagaagtataagacttaaactaaattttaaaataatttatataatataattaaactaaaattaactcttatatttcaattaacagattagtcacaaatctttcaaaatcgagtcgaccaaagttgatttccttcctacccttacactgttatttaaataaacgcactgcattcgtcaatattcacctatttttatttgaaaatctcaaagttgacaaaaaaaatagatttaaaccaattaaaatatttcaaatgattgaatacaataagattttttagatatttcaaaatttatcaatccaaaaaaattagattgatttaattaagtaatttgattgattttttaatttttaaacaaaatatattttagaatttatttaaaagataaatgaaatattaaaaagtcaccaatattactaaaaaatagagaggaaaaagcatgatttggtattaggcatgacaccggaatctgaccccgtggggatcgaatcgaactctccccgactttgacggggaaaaatcaagtcgaccgggttcggggtcggagtcggattttccctgttaattaaaacggggggggggtatgggataactgatatccgccctgaatcgccccgtaataaataacattaaaaaaaattatatttaagttgtttctttttttgttatgtaatttaaaggatgtgatacttaatcatatgatgtgctacttaatttttggacaatatatatttaaatgatatcgtatttgtgagaaattaaatatgcatgtccttattttatgcaataactatattttatgattttaattaaactaattgatttggttttgtaatttttaattatgatctcattctcatattttgaatgtgaatttattatttttttttgttatgtaactagcatttttggcccattttttcaataacaaaagttatattatttttctaatttttttaattttaattaattagcgagggtggattgagacgggaaaatcgaccccatccgggatggggtatatatttttaatcccaatagggatcagagagcggttttagagtagagggcggggatgagaaatgcaaaacccatcctcgttgtcatgcctagtaaaaataataaattagacaacaggatttttttctaaacaacaaaaagatgattttttaaattgaatgaaagagtaaaaccgaatgtcaaataaaataataaggataaaattaagagagaaaaattaaactataagctaatttattttttataaactacttcaaataatttatgaaaataagtcactaaaataaacttgtgtagcaaagtagtttataagataattaccaaatcaaagaaacttaagtattaattacaaaagaaaaaaaatactcaaaatagcctatattattgtgtatcaatatttttagaacataaaaagtaatttattgaaacagaattcaataacatcaaattatcttaaaatgtatctaataatatattgttataattaagaattcaaatttgacctcaaattaaaatgttaagaaaattctgaaatataaaaatttaaaaatatataaaaaagttatttaaatatatgattttctcatttcaatgatgttcttgtattttgtgcaatcagaatttagaaaataatatttttatttttcaaaataatgattttgttttaaaaagagaacacaataaattaagaaacaagaatacttgatatagggtaataagagcatctccaatggaaagtgcttatatgggtttcttagagtcatttattcatctttgttctcaccgtttataaaatttggaaactcactgacatgttttcattggctgcgatgctactaaacaggcttgacaaccaccaaaactatgttttcaacttttaaactcgattctattactttaacattaaataattttttggttctgtcatgaatatctccatttcagtgactaattttacttgctataaacattaactaatatttttttatcaagaaacatcaaataatttttttttctcttgtctcatttcttttttttcttagcatttgtttttttttttttaactttttcatatctaatattgagttcatctaccaccgattccaattaacttaggttaaatgtgatgttgatgatgatgaagaaacatcaaataatttaaattcatttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattaatttattaaagtttaaatttacataattatattaattaacttatttataagtaatttcataattttatttgttaatattatcactaaaaagtgagattttaaataattttttaagaagtataagacttaaactaaattttaaaataatttatataatataattaaactaaaattaactcttatatttcaattaacagattagtcaaaagtctttcaaaatcgagttgaccaaagttgatttccttcctacccttgcactgttatttaaaaataaatgcactacattcgtcaatattcacctatttttatttgaaaatctcaaatttgacaaaaaaaaatagatttaaacaaattaaaatatttcaaatgattgaatacaataagattttttagatatttcaaaatttatcaatccaaaaaaattagattgatttaattaagtaatttgattgattttttaatttttaaacaaaatatattttagaatttatttaaaagataaatgaaatattaaaaagtcaccaatattactaaaaaatagagagggaaaagcatgatttggtattaggcatgacagcggaatctaatcccgtggggatcgaatcgaactctccccgactttgacgggaaaaaatcaagtcgatcgggtttgggttcggggtcggggtcggggtcggattttccctattaattaaaaccgggggtatgagataactgatattcgacctgaactcgtcccgtaataaataacattaaaaaaaatatatttaagttgtttctttttttattatgtatttgaaggatgtgatacttaatcatatgatgtggtacttaatttttggacaatatatatttaaatgatatcgtattttgtgagaaattaaatatgcatgtccttattttatgcaataactatattttatgattttaattaaattaattgatttggttttgtaatttttaattatgatctcattctcatattttgaatgtgaattttttattatttttttgttatgtaactagcatttgtggcccatttttcaataacaaaagttatattatttttctaatttttttaattttaattaattagagagggcggatcgagacaggaaaatcgaccccatctgggatggggtatatatttttaatcccaatagggatcggagagcgattttagagtagagggcgggaatggggaatgaaaaactcgtcctgtctcgttgtcattcctggtaaaaatgataaattagataataggattttttttctaaacaacaaaaagatgatttttcaaattgaatgaaagagtaaaaccgaatgtcaaataaaataataaggataaaattaagagagaaaaattaaactataagctaatttattttttataaactacttcaaacaattaatgaaaataagtcactaaaataaacttgtgtagcaaagtagtttataagataattaccaaatcaaagaaacttaagtattaattacaaaagaaaaaatactcaaaatagcctatattattgtgtatcaatatttttagaacataaaaagtaatttattgaaacagaattcaataacatcaaattatcttaaaatgtatctaataatatattgttataattaagaattcaaatttgacctcaaattaaaatgttaagaaaattctgaaatataaaaatttaaaaatatataaaaaattatttaaatatatgattttctcatttcaatgatgttcttgtattttgtgcaatcagaatttagaaaataatatattttttttttcaaaataatgattttgttttaaaaagagcacacaataaattaagaaacaagaatacttgatatagggtaataagagcatctccaatgggaagtacttatatgaattttttagaatcatttattcatctttgtcctcaccgttcataaaatttggaaactgtggcatgttttcattggctgtgatgctgctaaaccggcttaacaaccactaatactatgttttcagcttttaaactcgattccattacttgaacattaaataattttttggttctgtcatgaatatatccatttcagtgactaattttacttgctataaacattaactaatatttttttatcaaaaaacatcaaataattttttcttttctcttgtcttatttcttctttttcttagcatttgtttttttttttttaactttttcatatctaatattgaattcatctaccaccgaatcaaattaacttaagttaaatgtgatgttgatgatgatgaagaaacatcaaacaatttaaattcatttcatctgacactgcatataattgtttgtaccttgccttttatctttttcacagacaatcattccaaaaatactctcccaaaattaaaggagacaacttgtcccattttagttgtaccaaaaaaattttgctttttaaaccataccaataacaatttggtaagacaataattgttacatataaattaaatgagcacgccaagttacaaagtaagaagattctcactcttattgttcaaatttggcaaagatataagtacaaccctttccccccttttaacccccaccaaaaataaaaacaagaacctctttttcttatgctgtaatgtcacaacttctagtctatcatcttatgtacaacatttggagaaaagaaaatgtgtctctcaaagtttgcaagatccaccaaagaaaggatgcagtggtattataccatatagaatgatccatcaaagaaacctgaaaagacttggctatcagcaatcctcttgatgaggcataatcaactccaccaaatatagagaagaaacaaataatcttctttcaaaaagtaggccgctactccacaacaactcattgttatgttgttaagagttctcatcaaaattggggatgccatcaaaactctgccatatgtatttaccatttggacatatcactcaacttaattgacatcctcttttaccatactctttactttggcacggaaatcctccaaactaggatactcttctcgaagcaacctgtccagttcagggtgttgattcaatggttctttttggccacggaccttgcggtaatgatgaaatgccctgccaatgccataaatataaatataaatatgtaagaacaaaagttctagagagtgataatatggtgaagaggagtgccaaaacaatagaagaaaactacatttctctatatctaacagatatgagggagacagtgccttgccttagaatatggcaacctccattcacccaaaaatatagaaatgcaatactaataaaatagtatgctagcatttgacatagaaactaacatatttgcaatatgatgatctattttggattagctaagcataggtaatctagtgttataacatgcacattcataacatttagaactgctcatactgttccacaaatctaccatcaagaataaacaaaatgctccatttcagtccaataatgcagtcaggaaatatgttataaagattttgtgacacaaacaagtcagacaaacaggaaataatcaaatataactaaggtactgtataattagatttcatagaccagtgaacaatctttttaatctagaatacaactataacaaaccaatatgtttacttctttcactataacaaatctcacatgaaattgggaaaaggaatgaaactacaaaacagaaaatatgcagtagaatataagaagtaagagaatttggttttttaccaatatttttccaggccatacagattgcccttatggtagaaatccagagtgagttgttcaaaatcattgtataaatcatctctaaattccttctccaatccataactgagcaagaaatcattcaaaaattagaagaactatgcttggatgtcttctaaggaaaaataaaaataaaaatatacaacataaagcaatttaatcagcttctccaaagaaacaatagatgaaaattcagaagacttgaaattagcctattactttactcgacaaaatggaccagaagatgaaatctaaatgatggttctatcttctcaaacaaatgagaaaagaaaaatttggaattgatacctgtaaaatctgaaaaggcactctataccataatcataattagcagcagcatcttccttagctaatttcttaaattcattatacatagaaggcacaaacatgtctcgaagaaaataggaccagaatctgtataatgtattcatttcctgcattgacacacaaaaggaggagaaagaaaaacctaccagaataagcaagtgtatgattgaaaaagaatataatacaagaaaataaaaatattaaatttgcaaataatatgaaaaccgaaatgtataaaaaaatatgaatgcataatatacaaagtgagctaatgaagatgacagcactgcatccaggctcattttgatatgaaagcttcggctaatgacattgttaagttaaaaagagaaagttgaccaatgcaaaccaatattgaaaatgccacatgtcataactattccacaattttcactcgaactattgcaacatactcgtacacaaagtattttagaagataagtcattcaattaacaaattaagtaataaaaaaggcaggcaatatattaaaagtaacaggaacagaaattgagaccgagttcaatcggtgggctaccaatgtggttctttacaaatatttttcatagaaacgtaagaaatggagttcacctcgctgcaaccaattccaagtttctttctatcattcaggcaccgtttgtgatacttcaagtacctgaaaggaagaatactaacatgaggaatttttaaaaagcaaatcctatagggctatatcctagtaccactctcatgcatacaaccagtaagcattatcatttacttctgttgtttgaaaccgttttcttctaaaagttggtgacttggatgctgaaacggtggaaaagacgttggcattgaacccacaggcggactaccagcgaaacccccatgtggactaccagaaaaccccccatggggactactagaaagacccccatgtggtgaactactcaatttggaaggcttgaaactgcaaatttaagataattaatggaaatagcttcagttgtcaaaccaaacaatcaacatgtcatatcatactctctgaaacagtaataatttatattcttaatttaacaaatcatttactatatattcttccagtaaaggataaaagtgagaaaaaaaaaaggctggctaagcaaaccaatattacagtcattagcactgggaacaatcattttgaactgacccgtgattttcaggaggcgtagaagcaaagaaaaacccaaccgaattactaggcgggctttcagatatgattccatgagagtttcgaccagttccatgatttctaaaattacttgagaaaaaccgctgcttaagggaagatggttgcttgtgaaaaactttttgtttccttcgggaattatagcttccagactcttcaacactgtttccaccaatattctcaactgcctttatatttgatgcacccgaattatggcttggagattttatgtttcgatctctgctatcagagttattctttctacgattagaccgcctatgtttcagttcctgtagataatgggtggggcaaccaaaaatttaataaagatgatgatctgaaaaataaaagacaacaggggaaataagaatagtgactcaacctgctcgtagaagtaaagaccatcatttattgcggaagcaagctcattggaaatggatattgattctttactaccacctctagatctttgtttaggatcaccattctgtacattagaacgtagttattagaatcttacaattcatgatttgaatcctacgttcaatacgatacatctatctatagattgtatcataagatgaatctcatttcattcttttcttctttacctttcttttacctattcacgtgaaagaaattgtgaagtcatataagcttaaattgttaaatggaaaggaatatcatgagcacttacaaacttatcctatttgattattgcacttattttatttgtcattcattcaatgcatgcactctatttggctatttcattgatttgttttcattcttctaaaaatagtaacttcacaaactaattttgttttataagatgtttgattaagtcgtttttatctattttaagtttaaactattacattaagttatttttcattgtctctgaatccgatttgatgcaaataatgattcacgatttgaacctaaatttgataaccttgcattaaaatataaaattattaaataatcaattaattgtaattaacattctaacatattatggttaaatcagttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagatagccgtatagttataacttataattaagtagtatacagagcaatatagttatgtagttcccgcctctgaacatccataaatcagaagaccctcaaattattttaattttcatcaccattgctgtttgggcaatatgaatgtaaaatcgaaacctaatttgaatgataccactttagaggaaagaataaacatatgaacttgattttaattaaattataaacagcaatacctgggtgacaattactagtctctgaacatcctgttcaatgacagccatctcatcatcttcatcatcattccttttagacaacaacttccatcagatgaatatttgaacaaaaaagtgaacatatgatatgcttaatgaaatggcacaaaaatcacctaatatcattccatatgggatgcctaaaataaagacaagtattctaacatctcaaacagaatactaacacagttttaacaaggaggaaaagaggaacctttgaatttcacattatgaagaaatcagtagttgtcttttattaacttcgaagaaaattgtggaaaatatataaaggaacacaatcaagccaagtgccaatttataaatgaaacacttgctgatattccactagatatcaataagataagacattgctgagcaaaaaaaaaaaaaaaaaatcaataagataagacagaactacgaagtaccttccactagaagaaagttcagtcttccttagcatcttttgctcaagctctatctcttcatcgagcataaaagtattgccaaaatcattggaaaggtctcggacatccatgtttccagcctcattattgtcaaatactttgggctcagtttcttgttggctacataaattattattagttgtttcaacatcacagaatttgacaccttcatgtgatttatcattataacgatggctctcattatttttttcttggttcatatgtgaacgttgtaacatatctttgtttggctgattatggtctgcgaaaattgagtcatgaacagcatctttagcattttcttcggaagtctccttcgtcttatctccaacagcatcaatattctcaagagaattgacagcaccatctacaagttggccctgttgaatctgagctgttggtgatcctgaatttcctgaggaaactcgaatccattttgaccaactatcacgttgccttattttatcaccctataaaaataaggcaagttacaagtgaaggcaacgaagaaaatgaaagaacacaaaaaaaaaaaatcaagtagttggaaaagtagcttcaaactttcatgcacttaaagctggctcctatagaactaaaagtgttattctatatataataaatatactacgtatgaaagcaggaagttctaactattagtatctataagctaacaatcataaccatcttcaactccataattcatctatacttcagccataacaaaatctgctttaaactttaaaaagccaaaacaaagatgccctcttgaataacagtaacgaactcgcactatgtaattctcataactcataagctcaacacatctatactacagatgatacaaatgtgatgaacttaaaagaattattctatacttaataaggaaacttaatgcatagttatcaatttcagatagctgtgcatgtcatctaaccctgaaaatttctatagcggtatagcaagaagctagacaaccactattttaaatattaattacaaactaaatttatactgcagataactcaaaaaacaaaacaaatgccaacattaaagaaattcatgataaataataggtcacattttacacacacaatcaccatcaatcttggagcaataagaacatagtaataaagtcaaaaaatgaaagatgatggtgaaattaatatgaaaaaaaacataataaattagatagaaaaaatattagcagaatgtgaattgggaagtctaaaggaagaagaatcacagaacacgggataaaaaatagtcctagaatgtgtgaaggaatagaggtcaaaacagaggtaactttttgtggaatattttacccaaaaaaaaatgatgttccagggataaaaatggtttttttaagtatatatcatggtagcgcggtgatagcatgcaaaaagctgctattgtagacactattgaaaaccactccacttcactatcctgctatagcacgctattgactactatgactcaatgtagacaatatttcaaaactgagttccttttgaaatatagtgaaacagttaaatatgcctattagagggtgagccttggcacaacggtaaggttgttgttatcttgtgatcaaaagtcacaagttcaaaccaaagaatcagcctccctgctagagcaagataaagaaaaaatagagactgaattatctgaattccaaaatcattgttgatattatggaatacaaaacacaagaatttgaattttaataaaggtcttgacaatataatttttgaaaaatcatcaataggatataaatgtgttgcattaaacttctcacaaacatgaaattgcatcccattactctaaaaatattttaaaaaaatattcatgtacaattcatgacataaacatttgaaactaccaacccccaagcccaagattaatatcagagataaacaagaagaatataaaccatcagtattcagcttaggggcgaaagtattttatgcaacaaactagattctagagttaatgagaaccttagccctgtctacacccgcaagcatgcagtaaatagtaaataactaaaccaagaaaagaaaaattgcctgaacttccacagtattagagctctcaagtgcatcacggataaaaggtatgtctgtgctcatcttcttgacctacaagataattcacatcatataaggcaagtgagaaacagggactaacatggaactcaccaacagaaaacatctgcaaatatatattacatttgggaggaaaaaaatgctttggacacatacccttttaaaatcagcaacagtggatatgggaacccatccttggtcatccatcaaggaaataaggtaatggtcattctgcagattttcatcactgccaaaagaaggctctgaagtcagcagttgttgtaaagattatctttattttcaccgaaaatggaatcaacagaaattattactggacttcctaagaaaattctaatgttcattagcttgttcctgttgctttaacaatctgaagcccaaacactacaaatcagttccacttcatcatctctggcaacaatcctatccaaaggctaaatttatgcaattatcctaatctaaaagatatgggcttggcatctatgaatctaatagtacagcactttgcaataacaatatacataataacagtatattgtcactcaatcgaaagttggaaacatcattctcacaatatagattagcagatgtcagattaaaaaaaaaaacagattaagatcaaatatgatatagaagccagggtcaacaatgaaattacttacctaaaataatagtctatctgttttacaatactagtcctcaacgatacagtttctggaggcggtggctgaggtgtgggattgacaggatatgggacaaagtgcctaggatggggtcctctaatggagccaggaggtggcatggggacacaccaaacgggtgcaggtcctatccaaaagataaaaattggattacaaaactaactgatggagaaattaaaaaataaaaacatcagagaaaaatccttacacagctttcaagttgagaaatccacaagtgactgggaacaagaggaagcatagatgtatgtgtgtgactatgtaattgcacaactatgtgcataaattagaggactatgaattggaattttacctgggaagcttggaccaaccatgtaccctggaggtggaccataaaatggaggtcgtataaatggccttgggcccaaaccatgttgcataggaatgtttgctctggaaggaaaaggtctttgatgatgccaagcatgattgagatggtcaccttgttcttggatatttggtcttccattagaaaaattgccaacataggcatttggatcttcctgcaccggaggctgaacatttttgccatcaacagcatgagcaggtggagcaaaagcttgtccgggcgcctgagaaacaggcttcactaaagggttttctgcacccggaaaaggtcctggaccaggtgggaaagcataaccaggaacagccatgtgcggaggcggtaccataggatgaaaaaatggaggaactggttgatgatagtgaattggtacagggaagggaggtgcaccatttgagttacgcttagcacctggcttttgatggcgtgataatggcagcttatgcattgggttaacgtttccagcaccattcaccttcttttgaaaaacaaaccgatgcacgcacaaacaagaaaagatattcaataccaaaaaaggagaactttgttgcattgcatacaactattatttctaccacaaaatcaaaagcatagatgaggaaaaaacaataagcacctaacatatttgtaaaaccataagaacacaatgaaatatactccttatttacatacaatctaatgttaatcagtaaccacaattgtcatgcttgcaatattcaggcttaaatcatgaaaatcgtaacaaacataaatgtccatcctaaacaaataaactttgttataatacaagacgacaaaaacatagatacaaactcaagaacatattacatttccataaatctatgcattacattttccatatcacaatcacaatggtactacacaaagaacatactaacctgcataaaacgaggtctgggagcaatctcaccagagcttgtcacagaagcagcagcagcagcagtctcaagattcttgggtggtctctgtgcatcagagagacgtggccaagactcggtgcccatcatcacagacacatcacctcccttcccatcaacagtaggggtcttccatggagacttaggagcagcaatctccttctgatcctcaccaatctcattctcagcagtcaccataactgctttttttttctctcaccaatccacccaactcccaagatttccacctctaaaccccacttgccaataaacacaacactcaacctaatgggtgctcagagattcaccaaaaacttaaagataccacaagaagattgaaactttacttgccatttgaatcagtgatattgagcacaagaaccctgagccgaacaggcgataatttcatgtgggtgtgctaaaaagggttcctcttgtgaagttttaatgaaaggagttgggtcagtgtgacaacagaagaaaagtgaaagattagggttttggacagtgaggtgatggaatgttatgagtgtgtttggagacagtagcaatgttaacaaacgccaacaaagtgcgagggtaactgatgaaaaggcgactgagggacaaggtttttgactttgtgaatgctcctatttataagaccatatacggatccagaaatttattaaaggatgagctaaaaaaaattctctctctatgcaattatttaaatgtttaacttttaataagtaatatttttttaaatttattttactatttttactcataacatagaaataattttaaatttaaatgataataatcttaacctctatcataaaaataataaataaataaatagttttacataatttattttaattatcattttaaccattatagtaataataataacaaacacaattaattttacattaacaaattttataataataacaacatggataatttattttatgtagtttacattaattaatttaaataaataaataaatatatatatgtaagaaatactaaatgaatggggctcaagctcttgcctctatccctctccattcctcattgtataagacattctttaaaaatttatttatgctgcatacttgtttttatttattttccctcccaacattaataagaagtaattaaatgaataaatagataagaaaaggttaattttgtaataattatacagataatttacaggtttgatatgattatttaaatttctttaggaaaaacgtgaattaattttgaaaaaaatctagaattaagaacggagggattatataggaaagatagttttaccccatgaaatatttattctactactatctgaagcaccaaatatagaaaagaattctaaaaatattagaactatgaatcacatacatcactcaacattcccaattggttgtttctttgcgccatttggaaccagccaaaaagtgtcccccaccaactttaatatcatataattaatgtagtacttaatagtatttgacaatttttctttagaaaagataatgctgtttaggaaagtaaacgatataggagtagattaaaaacataaacagttgagttctatggtgaaggttgaaaacctgtgtttaaatgaatgtgatgtaggtgtatttttcttcttcttcttcttctagttttgaggttccgaaactaatttattattttacagcttttcattgtgggttctttattttgggtacatggggggagggtgggggacgagacttaatgccaaaacaaacgcgctttgaataagttggaaatttatttttgtattgtatttgtacgaatgcttttaattttaaataaatgtaaaaaaaaaaaaaaaagtatcatctacttcccataccaattgaagtacaacactaaaaaaaataacgactgtgttttaaaaaaaaaaatctaattttattagttttgaaatgtatatgaaagcttacagacttttttaaaattagtttaaaaatatatctatataataataacaacaaaggggtacaataatgaattaatgataataagaagaaggatgaaaatggtgatagtgagaaagtggacttaaaaatgacattggggaaagttaatcgggccactcaatcagtaaatcgataggccaccggcaaggttgtctcgttcggacgctatgaatttacagaaaaaatgtgtaaaatgttattaaatatatgaatatgattggcaattataaagttatggtctcaatatggttggtaattcacttattcaaaatataaataaaataaaaaattattatttttgttagtttatttgataaactcaatttctgtaatactagtaaaataaaatattttcaaatcaactttaggttaagttattgatataaaactataggttcgttaactaaatttgtaaacttatattaaaatcttaaacattttttattttcttctctcggtcaactcaccctaaagtagcactatgctgattttcaacaaaaccctccccagccatcttttggcaagattatgatgtgccgggatatatcagactagttcatttgtcattagtaaggattgagatgtttaaatttaaattgatctaaaatgaaaattaaaaattaaacaatattaattctttttttatttatttggatatttttttaaaataattgattagtttggtttgatttacaatatgtttagtttaaaataaataaaaatttgatctatttttatggtaaaaggtttaacatattaataaatttcataaattatcattaataaattttttaatatcttaatttaaaatataaaaataaagtatataaattttaattaaataatattttaataaaattataaaaaccaaaataaatcaaattatcaaatattaattttattttattcaaattttattttaaataaaaatctaaccaaatcaaaatggaaacagccctggtcatccctaacagcgttattcaatgataatgataagtgctggtgttttttattccttcttgtttttattcaaaattataatagaaaagaacaaaaggtaaaccaatcaaattctcgtaggaggtacaaattttcaagtgatttaatagaccgtagcatataaatatgataattacaatactcactagctgttgccttcattaatgtgattggtcacttgttttagttttattaaaatgcaataaataattttaagattattgaatttttataataattaatactcgtctttgatattttaccagctagtgacaaaattatcattttacaaactgtccattgcatactttttttatacaaaatctaccctcccttgcttccaaaaatttccattttccattttgtcactttgtaaaagatggaaaatcagcttgaggatacaaacatgaatttgaataaatgatgaaaaaatggagccaaactttatgggtaaaagtatccacaaaaagagaagataattattcatttattaagatgaaggataaaaacgagtatttacttgtactttttgcggaatttgattatcactaatttaccaaaattcccagtaggaattatgggaatataaagcatttctcatgctatgcggtccaccatgaccaaccaccaaagtatacagatcacgttggaccagctcaaaatgaaactattacatgctcgtccataaaataaacatttctgtctaattatatggtccacgtaaactagcaccgtaaatccgtcgtgagaaaggcaaatcttagcatggagaaaattgaatttaaacccccgtaaccctgttacccttttccaatttcgttgacaagtttttataacgcaaacaaagcacttaaacaaaaaacgggggtaattatttaactacaggttcttccagtaaaagtttcgggggtcaagtgttggaagaaacctaaaatttctaaatcaatgtaacacctcgcccaagatcaactagctcaaatttattgaagctccaacaaaaatgtaacaagacaaagttaagtattcttttggaatattatcagtaatcttcttaatcaccatatcctcaagccaatatataatatcttgatgttcgagagccagatttgcagttcacgcatgtgccaactgccttctcaagctgtgtgatcaatatcagtaggatcttcattataacatccagaatgttaaatagccatcaaaaaaattagtccttgtgagtaaactatgcattttcagtctcacgcaaataaaaacatgaagaaaacattacactttcttagactacagcttttgcccagtttggtattgccttcataagcccttaaaaaagataactgtcttggacaagattttcaaaaacatttttggcaaagcaacttattttggtatgttaagttttataaaatatacttcttttgcagctttaccagatattaactttcaccaaagacagcaatatcaaaatggacctttctccaagaaagattgtacgtaaaaaaaacaaattgaactcccaagcgaaatccagaagcccaacttgctaatatattagaattaaaatatcttcagaaattagttaaaagcttcagaaagtgaacacttcagaaattagttaaaagcttcagaaagtgaaaagtaggcaagtttccgaagattaactttcccagacaataacaaaagaaaagatcatacccatggataactgcaaagatgataacaccatcgcacccatctgatcttctctctgacattcactccaaaccagggtacacttgtatatagtgagagccaaccctcccaccaagtgtggacatttctttgccttagaagtgaatggaaagacccaagctccattagtggatgcagatgacagaagttatgaacatattcaagcttgtttggtagcaaagacctatgtgtctagataagttgccaacaaagttaaacataacatctccactaattaaaaaaaaaaaaaaaaaaaacatgtagaaactaggaaaacaagctaacttacacccaaagaactgagtgcttattttcagaacggagtaaaaagatgaccaaagtcaggtaacaattcatttcaataactgttcaatctttcattcaggaaggagaaagaaaaaatgattttctcgaacaagatccttgaatatagaggggacaagcgagtgaaaggatgatggaaagacaaattatgacaaaagacaatccttgtttaatgttgttcctcatcatacttcatttcactttcaatctcccagccaaaaaattcaatggaaggaaaaaatggttcgcaaaagggatccagaagaaataattgatattcaaatgttacacggaattaataagtaaatagtagtcattacctataaccataaaaaatgactacaacagtagtcctcaaatccccaaagtatattcctatttttggataagaacattatacttatgaaaaagatggtagtagccctcaaaaatcaaggctgaatgccagacacacgtaaaacatgtaaattatactcgagtcagttatgctttgggaagctaaataaaacagaattggacgttcataaggaaaaataatggtccacaacacacttaaaaaattattatcataaagttttctcttccccaaaattcacccgttcctcaatagtccataaaggaatacgaggtataacaagattttaaaaacatgtcaggggggaaatctactaagataaggggggaaaatacaagtttcagaatctggttctttagtaatcaaatagtaactaaaattacagattaaaagatgcatttgaatagtgcctggtacttcagaagaatcagcggagtccaaaactaaatgattgatgcatcttatgagggtatctgcacagtgaatacatagagtaaaaaaactaatttcacaaaaccaagtgcctatagaagaaacacaaatacaaatatgaacttttaaaaggccatacctctggtactgcaaaatagatttttcaagagttattataatgttcaaatttgaactacaatcccattcaaggtaattgtttatgcaatacaaaatcaatattgacagcaaatggtagaagtgttaaacacaagcctaggaatgttaacacacagactatgaatagatcaagaaagttgatggaaatagagctcagagaaaatacaacaaatagttattcataaatcataaccgtagctaaaacagctaagactgagcagtaatcataaagtagcatcactatctatataaaacaagaaaggcacacatgtgagaaacagattaccaaactagacattaacattataactgcaaaacaaaatatggaaagcataatttcatcaggtccaatgcaaccaaacacaattagtatgccacttgggctcatccatgagtgaaagaagcctgactgaatcatgcaattggttaactaattttaatactcgttttagtacacatcaatatcctcagcttcgtgtaattcattatttaccaacaaggggcattcaaagatagggcagcctatggattaacaacaaacaaaaattcacgagccactcacctaatgacccatgtaaggagcaccaggaccaggatgaggtctcacaccactgctctgtcccatttgaggattctggtatccgggttgcattgctggctggttcccataccccatagcaggctgatttgcatacggagcaggcggtcccgcctggttaaccggggcaccgccaagccctccaagcagattcccaagccccaatccagctccctggttaatcaacgcagtcaacgcctgtccaagtgctggattcaacccctgtgccggcacaccagggttgaaaccccccacagcagagcccgagggcgccatcaaatgaccacttccaagcgatggtccaccaccgccagaggaatacttgttcttctccttcctctgataatgaggctgatgatggtggtggtgatgatgagaatgagaatgctgctgatgatgataccccttgctccccttaggaccatcaacagccttctgacaatacaaagtatgcccctcatagttcttatgaggctcttccaaagccttcttagcactctccacagacttatacacaaaaagcgcaaaacccttaggtttcccagtgttcttatccaaaccaagaggaccatcctcaacctccccaaactgtttgaagaattcaagcagcttctgaggatcaatctcaggattcacattgctcacaaaaatcttcctttgggtgtactcagacaccggggtaacattcggcggtggagccggaacggggccggcagaggccagctggcacgaagtggtgcggtttccgatcttcttttgagggtgtttcagcgccttgcgagcatcgtccctgtgcttaaagaggataaaagcgtaaccctttgatttgccggagaccttgtccgtgacggccttgcagtcctcgatctcgccgtatttcccgaacacggcggttagagtatcggcggtggcgtcccagccaaggccgtggacgaagattttcctgtgcgcgggatccacgtcagcaagccggcgcacgctatcgacgaattcggggaacatatccacggcctgcgtgacgagagagtggagctgctcctttgtgaacggttccagaagcttctccacgggctcttcttcgagagtgagatcctcctcttcctcttcttcgttgtttccttcattgctgccattcgcttcggcgtggtttgcagccgctagagtttctggatcctgttgctcttctagggtctctggttgccgctcctcttgttgttcctctgcttcctcttcctcttcctcttcctcttcctcttcttcgctttcggcgttttgcggctcttcttcttcttcctgttttggttcgtcgacggccatcgtgttgggatcttctagggttggttcggggttgggttgttgttgttggtcgagttcaactggctcttggtcctgttgctgtggctcgacaggtttggtgggttcggggtcggaggatcgaagttttcgtttcttagccatggcggcgaggaggtagggttagggtttcgggaattgggggtgttttgattttaatttgatttgcctgaagaaagaagaaagaagaaagcgagatacgattgcgcctctcagtgggatgtgaagtagtagtctatttcaccgacgctgtccggttatttctcagtcagtgtaaatggaccgggccgggccggatctctacttctccaacatgtaatatgttgcaatttgcaaaagatcttaggagagtttttcttttttctttttatttagcaaattacattaatacttcctcacatttttttagattagacaaaataccatctttgattaacatttacaagctttgcttattggattatacgttatactaatgtttcttatttgtatctccaattattagaaattaatcaccattacaccattttatttttgcatttatatttttataaaataatcattaagtaaaaaaaaatgcacatagttaacttccgtatctagtccacgcacaaaggttattgtactggtataatatataaggggatgttaattttttttaacattaaaatttaaaagtattggtgtaggaatagaaagaaaagaaaaagtagtatcctgttcaattcaataaaaactcaagaggtaagtgtaattttttaaaatatgtgttgataatttagctttaacttttatttaaataaaattgttcttgtatgtatttaatgaatgattggatttcatttgtcacacgagtaattacattaggacaaatttattaggatgattaatattttttatgatcattgatttttaatgtataatagctcctagatatttttatttaaatttaatttatacaatatttatataaactatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgatatgaagataaaaatatgtatattatgtttttataataatcaaatttaacttatttatatggtataaatatatttttaagctttaaaataacattcatgataacttatttaaaatataatttgcaacaaattttttaatatataaataaggcatgactttatctttcaataaaatcaattataagtttaacttgactctttaaataaattaacatgattaaaatttttaaaaaggcaaaaaaatataagattttaatatattataacaaatttaatataataataatattaacttatgaattttttaataagttaatctattttgcttaaaagacatataatctaatatgtttaattaaataaactttattataagctttgacctgatttattttttttaaagtatgatccaatttaagtacaatgaattaaatttaatttaacttaaactaaagacttagacttgttaattgtgacttgttactcacatcatcaaatgcttatatgaatcccatccgccaatacacaccaaagaaacaaataaagaatattcttacatcataatgatactaatctcgctacaagtatcagaattgtcccttctcatagtaaacgacccttcacattgtaaggatttgtcatatgctttattcatttttgcatacgaaaaacaacatttcaagtaactaaagacatcattatctttcttaaacaagttgattgataagtaatacatgtgttccttgatcattatattttggtttgctagatccttttgggatgcccgacaaaacttgttccctttccattcgaatatgttgaaatagttatttgattttgtccatttattcacccataagtttatacctcacttttcagcctaaatttgaggatacatgtatgattaaatagtaatataagaaattttatatcatcatcaatttattatatatattatttattttatataaataccttagaacatctataatacacaattagataaattatctattctattttgtggatcttaccgtctcatataaatttaaacattttaacaaaaaattacttctatattaaaattgttaaagtgagtattttacttaattttgtaaatcattccgtgcttgaaacatatgtgatttataatataaatgttgttaaccaactacatgttatatatcccatcattcccatgagaagaagaaaagctaaataatattgcttaaaaatgtataaaatagttatctgttatttctcaccagacatgttcttggtctatgtaaagttgttcaacgttctctgttaccaagaatcacacctgaacataataataatcgaatgcgaaatagcttttttccaaaagagagaaactctgtttgtctttaataagattatccatacgagttctaatttagaaagtggagtttggtaattggggagcattgcttttcctttttatttatttttatctattttttcacaatgagagagaatcttatccgaatcccttgtacgtcacgtgacaatcatagcccgttggacaaaaccaaacgagaggcccccttacacgtgtgtcctcgttgccacgtacgaaacctctctcctcagtcctcagcacgctactccacgcgcccactgctgtgcctcttcttcccttgctcttgcgccaattttattttactttttttaagaaaaattagataaacattccttttgctatttttatcactatataaaatttcacatgaatctccataaataatttaaacctgattctataagtgaaaccacgtaataacttcttatataaaacttatttggatgtaaaattaaaaatatttttgagtatactatatttataatagataaactcttcaaaacattctaatttatatctaaacaggctcatacccaaatgcatcaaattttggtcaatatgagaaaaactaattttgacattaccaataatgattcaactacgaagctggtattgaagtattggtaatgctccaaatgctggttagaaggcagtcaagtcaattgctaatgttgggaatggtgctggctggtccaccaattgaatatgatcgtggaataattgtagaatatggctctgttctggtgcatcttcctggaaggttgtatcattcatatttcaatgtttttgcgtaaaatattaagtccaaatcattatttactttattggatttaacagtgtttttgcgtaaaatatttagtcaaagtttttttttctaatgaacttgaaaattaagattaaaaaatataactatatttatttttcaatttttaaaatatagtaatttctaatttttcatcggacacgaaagaaaaaaaagagagagagagagagagaaagggacaggtaaaagtgcgtctaaaatgggtaaatgtttttctttgatataaaggataggtcgatatcaaaatcaataaattgagaatataaagcaatcgactcattctcttttactgttgcgcgtgttcttgatcatgcacaccttcgtgttccaatcgatcctttgaaatacagacaaattaggttaaagcgtcttagaaatctgtcttcataccgctgaatctggtgcttgtgattaaaatgaatgtggaaacttttttctcagggcatacgtgtatttaataaagcaatttggtaaggagtcaattttagcataagggtctatctcattgcaaaactaaaattgtccaaatatgtgatggtgatcgatttggaatcacctctcacttgttgattgaatgaatctgcacgctcttcttcaccttggagtcttctgagtttggagattttttttttatttatttatttgtggaaatccaacacagaaatcaataatttataataatttacacactatttttaactaaccgcattggattttctcagtttagagtttgagaaatgaaaaaagataaggaattaaagaataaatagagtataaaatgaaagaaaaatattgtacaaacccaaccatcaaaccttttcacttctatttgtatgtactaggtgaagagaaaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatataatgacttttaaatttaatatttaatattttaaatatatttattgtgtatattattattattattattattatttatttccatacttattctgaaaaattaaaataatgatttaaactatgtatcttatagattgagttgaattaaatataaaggaaattaaaatgattatattagagttttatctttaaaattgatttgattcaacttgagatttatattgtttttgataatttttagttttgagacttaataatacttacatttttattcttttaaaaagtattttgtgaaaattaaattaaattactcaaaatcaatgagtcacatcccattgaatacatgatgttttttttttccgatacatacatgaggttcatataaatagtagtaaccattatgaaattttattaaaataatttaattacaaaataaaagaaatcaaatgaaaattgaatgcgaagcaggtaaaaatcaggtaagaaacagggtaagcgagatttccgtacttccgttgcagagagagcgtggaaaaacacgcgacgaggcgagagtggaaatgataaataaattaaaaggcttatattttcctctcattttttctttttctgaaatttataattttaatttctcgctctccaaagtccaaacagaacacagcgtcagatcagactcagacaggagaagttgataagaacaaacaacaacgccaccagttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctcttcttcttccctactctcactccctatatcatttctccttccgtcgtttctcttctccctcgcgagcgtgcattgcattgctctctctctctctctcacacacacacacacaacacgacgacgtcgccgccgcgcaccgtttcggttttcctttctcctccgtcgattgcttccgcaaatagcttttcgcatgggaaacgctaacggcagagaagatggatccattcccggcgccgccgatccctcggtcgccgaacccgccgtacgtggaactcacgcgccagactcgcgccctccggttcgcgccttctcatccgattcaatggccaatagcccgccgcagagccctcgccgttccagatcgccgatcctcttcggtcctcaggttctctccacaacatcctctttgtctcttgcttcctcttcgatttttctgcattttaaaagtcttcacgctttttcgtttctgctgaatttaattttactagctagggtggaattttggttttgttcggtcaactaggttattcgttgattttactttctgcgttcggttggtgagtatcgtgctaacatatgtctggtgcatgagagacagagagcgagagattaggaggcagtgtaggtagggttactttttttgttgaaaccgtggattatttactgagtttattttttatcgccatcggagttgaaactaaatgtgttgttgaacggatctggtaattatgttgttgatgtattcgtcctttctttcatggatcatcatgaacgtggttcagattgaatgactgtgtttggatacatgttgtggatgtaaaaatttacgtcaaattgtagaataacgtggaagctataattcacagcttctttactgacgcagaaatatgcttccaaacacgcaataagcatgacagtgaccaacaggaatgtggctggttttgatcgaatgcatatggtttgaattttgaaaactcgtttggggagggcatggagggcagaatggtgtggatcttggagattactgctacacctgcttgttctttttgaaaatgttattgatgtgtatttatatctgtctgtttaaggagagtcacccctcctttttgtagactctgtgcaatgctgcaatcccatttttgtgtagtgacagtttgaaaacattttacttgatttatacttatgtgagtctcagcttcacagctcacacaactactacacacgactccatctaagtttaagccatcccacataattcttttccggttaaactcacatgttgtggatggttgtgaccggatagttacgccatttggaaatacacatttgtagttttagtctaccgatattaacctgttaattttgtctgattcggaaattgcatgcaataatgtcctctggattgagcgtgtgaacgtgctgtttggaacgtgaccagttatatcacttatatcatggaatcagttttatttgtttaacggtataattttgttttatgtcaatttttgtgatgcctgtcctccgttactcacattcctcaacatttctccatttgagaaacaacacgtgaaatattgcaatacggatagatgatactgcctgctaatagtgatgcaataattttttgtggttatgttctaatagctgttgagggtgtactttcaaaagtgctacacaagactacaagcttggcattcaatgtacattcaatatttttctgtgcctctattaccccctacccaatgttatatcgatcccatgaatttggtaaatatttgcccaatgtctcttttatgcctattaatgttctgaatgtcctttttttgtctttgatttgtggagaacctggtgaaaaagttatattctataggcacctctctctctcgtgtagagttgatatatttccatgtcgagcaaaacttaaaagacaagacatgcttaagtttattttgtatgaattactgtccatagctatttggtggcacttttgcaccatagctacttgcccttgctaacaactccaatgaaactttgattatattttcctataaatcaggaaaattagaggacattcatgttttagtaactcatagttattgttactaataaacatagtagtcaatcttgtaatagtggttttgtggtatgccgctttgcccctctatctgggattggtgactagactaataaatatgttagagctgttctcaaggttgtaaacgaagggctagtgacatacatgtgcattaacaatcaaaacaacctccctccactttgtttttttcctttttgtgaaaaaaaagtaacaaaaccttaaatttgcctgtctttgaatataaatttggaagagagaatattattatgtgccattaaataacatggttgctagataatttttttgatattaatatttaatatagtttgatctgagaatgcattgtgtgaaaaatcatgatatacttgttgatggatcaacttaagttgcgtgattatacttatactttctattgtaaattttctttaccttgagtgatttttgctaatgaattgaagaggttgacacttgacagaaatgtatagttttgtgaattaaaatttctctatctgaaaagtgtagtttttttgttataacttgagcactctgttcttgttgacttagctttctcccatggaaatggtaaatatattcttatacatcttttatgatctgcaatacatatgaagctttctttcttcatgtgtgtgtgtgtgtggctcactgaaatttcaatttctttctagttaggatttttttttttttttctgggttaggaaacatgtaaatctcaccagtggcaattttgcattacttcaaaataaatgtagaatttccttgtgtttttcaggttcctctagctccattacaaagaggtaatggccctccttttctcaatcaaatgtggcagaatgagtctcacggtattgttaatcaacttcctgagcaagggatccctgtcatgattacatggaactatggtggtaacaatgtggctgtggagggatcttgggataactggacatctaggtgagatttaacgactccttttttggtaacaatagtgctggattgtatttgacataaaaagttatcataactgcaaatgatctacaatgagattagtaccagtaaattttattacttgcaggaaggcattacagcgaggtggcaaggatcactcaatccttatagtccttccaccaggtatatatcattacaggttcattgttgatggtgaagagagatttattccagagcttcctaatgtagctgatgagatggggcatgtctgcaatcttcttgatgttaatgtatgcatcgacctatttgtttctttctctttatgaaaacaacatcattttgtgaacatattttcatcatgaaatttgttctcctgtatatttaattgtgtgtctgcattgaaatctttttcttctgtgtcaaggtgaatgcttcagttgggttttaagatgaacttgacatacaacagataccgaagatctttcccccctccccctcttctaggtctttgttgtatgttgtatttgtggtgaggagggtgaggacaggtaggggtgtgcaaaaaaaccagttcggatcgaaccggattgcaaccaaactgaaactgaatcggtttttatccaaactggtttgaacaaaaaataaatgcacggttttacaaaaccagtttggttaaccgaattgtttatacaaaacctatccggttaaccgaactggttttcaccggaatcaaattccttttatttgaaaaacccagtttgaaattcgtttggttcttagaaccagtttaaaactggttcaaaaccgtttttaaaagccactccagttctgagccggttttctaaaccagttcggctatttggatataaaaccgatttaattgattcagaatcagttcggttcgatttctactggacaggtagctaggtgggtggggcaaggaaagagtaatgcatcctatgttgttttgtcatgtctgcactctgcatgccatatgtggagatataggatgaacatagacgggaaacactggtttctgcactctactattggttcatggaaagccatttttcataggtttttgtgcttttagggctgggcattagtgggactgttgaatgaaaatcgagtaataaaaactagcaaattgtttcacaattttgctttacttgactatcaatacaaaaagaaaaattcagttgatttgtctttcaattaatgattttaaatgttatggttttctgcaggattatgtgccagaaaaccctgatggtgtgtccgagtttgaagcaccaccctccccagaatccagctatggtcaagcatttccagctgaggaagactttgcaaaagagccgatggccgttccttcgcagctgcatctgactgtcctaggtatggagaactctgacataggttcctcttcaaagcctcaacatgttgtgctaaatcatgtcttcatagagaaaaatttggccttaaagtctgttgttgccctgggactcactcacaggttccagtccaaatatgtgacagttgtcctttacaaaccactcaagaggtgaaatatgtgacgcttgtcaattatataaaccttttttttttcttttttctttttggtagccccagtctgtaaagatgaaaatttaaataatactccttgacaggtggtatatgaagggcttgtgtctatatatgcttgaggcttctgttcaaattgataaattaaaccttttgtttcttttccttcttgaattattgaagtatcaatatggtgtcttatggtaaagctactggaggtggtaagggggtgctggtcataattatgtttttttggatcaaaatatcaaattattagcttaaaataatggtacctttggatggaaagacaggaaatatagagaaagtaactagagagaaaatatgttattttctctcggtggaagaaaaagtgagaaagagaaagaaaaaattgaattttagaaacaaatttggcttgcttattttatatttttgaaaactgttttctattctttgaaattatttgatggaaatatatttattgaaatatattttcaaaacttttttttttttagtttttatagccaaaaacttgtatcattttcaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctatcaaacacactcgtaatcattacatgcaaagagtagaagtagtgagtacaagttcaataatcaaaggaagacatcaattttcattttcatttaaattaaggaggacacatgaataaaggccatatcaagagcagaattgtgtgttgtctgagggatcccgcagaagtttgtgaagatattttggattttattatagagtaaaaaattctaattaaaatgattatataaaaaaaacagttaagggatcaacaacacctcctaggctgaaaaaaaggtcgatacatttttgttgaatgaattcatttttcttcttctaattattatgagaaatatggatccaaaatattattgtcctttaatttaatgtataaatgttgttaaatttatattatttgaataatctgcactgcaccccaagagatattgatatggttcctcccttacgtgcaacaaaatcattgagattcttctgtccaccttattattttctccctcttcccttgtatttttatcatttctttttctttttctttttcttggtaatttatctccttttaacttggttcctctagtttgcacactttattctgcctacttgcttttcttttttaaaaatccatgattgaagctttgttctattcgagatttgaagtatgtatagctattgcatgcatgcctaaagagaccttagtcggcatgatattttacagacaccaaacaaagccaacaacatgcttgtgcccgctccatgtttggttgtgaaaaaagttttaccaattaccatgctaatgctaaatatttaatttaaaggaataaaatgagtatacaagtgaaaaaagatgaaagatttaaattaaattaaagaaatgaaatgagtgtaaaagtgaaaaaaagatgaaacaagataaattttttaaattaaagtaaactaatgaaatcttagaccaacaccaattcttaaaattttcatgtccaacataccaagatgaaaggaaccaaacactaaccatcgtgagtgacatgcaaaatcccaaaggggtcagaaatgaagatgccacagtatagtaagcaggttaagccgtaccataaggtacagcatgttactatttataacatgacgactgtgccaatacagtagtacaaatgtacaatactatgtactgaagattccttttctttttaaggatgctatcacttatccaagttaacagaatcacgacaaattggacatctggaacatgaaacaaggatctggatcttctagacttctacagtttcaaaattaactgcacctatacagttgcaaatcaattcattaaagttaataaaatttaattttaaatgttaatttattgcataataaaataaaatgaatggattcataagattcatccagtttctctaaaaactgttgaggatcaaaatcccgaaaacagatgttaacaaagtcatttccgtgggataaattattcaaaggtcctctcgtgagggtgtgtttgatacagatgcaaaagttatttcaataatcaattacatgtataattgattataattagaattgatttttatttgtataagtttgttgataaaaatcagctttcacataataaattagaaaaaaaaagtacaaggttattgggcaaaagttgttgggaaatttgggaataacttaagaattatgtttttaagagaaaaaaggttgttgagaaataatcacaaattcaaatttttagatatatgaaagcaacttaattatttttcaatgtattttcttaacaaatttttagataacgaaaacaacttattttttcaatgaaaaaactttttatcaaattttggctgatgtcctaaacactaattatttttaaaacacttttatttctataacaaaagctaaaatgaaaaaatagggttaaatctatttttgctcctttaaaaatataacaaatttgattttactccttgaattttttttcctttgcatttgattccaaaattttagaaatgttagattttagtccttttctttaactatgttaagaggtaggagacagtgtggtgagtggattcaatgaggatcttgatcttaagcaattacatcaactcagaatagatccctgacgacatccgtcaaaggaacattatcttctccaatcatctatttttattacttttttactttttgtaattatgtttttaattggttaacttaattttgtttttaatttttctaattagttacatgccatatcaagttacttcaaaaccaccgactgggatgaccacgtggtcacatttaactatagaagaagcaaacataattttaaaaaaactaaaatttgatatttctaaaattctggagattaaatgtaattttttttcttttaaggaattaaattcaaatccaatgtattttcaaaggacgaaaatatatttaaccccaataaatattatccaaaacatgagtggaggaaccctccaaacatttaaatcattgatttaagtaatatagaaaaatggatgtcttttgacaaccaaatatattgtcaaggaaaaagtgaaaagagtaatgcctcattcatcagccaaatacattttttttatttatttatctctttttatcacatcacagcttccataagatctatcataggtgtttatacccaaggaaaaagaggaagaagttggtgcctccacgatggtggttctggcattgtgcatcttcaaaagcacccacatgttaagaattggcgcagtgattttgactttgcttgtgctttcgcagtggatttggatttggatttgtattttctgctgctagcacaatgcctcattctgaaagaaattaatctcgtgccatcagtaagggaaaatctttcgtgctcaggttggattgtgcggcatcaatgtcccacgtagaaccatttaatgtaacaataaataatataatgtttcattatcttaacataattgctaagtaaacatttttggggttagcttcgattttcttgatcctatgcctttttatttgggttccaaaggcacgttcatgggacgtgtactagtttgatgtttgcattttaagtacattattatcctagttatcggaaacgagatctaaacaagttggcaaggctgtgcatatttctttaattattagtaaaatcactttttattttgctaaaggcgtgttgacaaattaaacacaacactcttgatctagatcgttgccatgttgttattaacttcttcattattggattgaagtcgagaaatgcaaaatgatcacagaaacaatcatataatagcataaagacggttttaacagtataagtcacccacatgtaaaagcaccaattgcaaccaattgttccagtttcatggtagtaacccaaaaaagatgaaaagtgaagtacaaatgcatggtgagacacagctaatccaagctactaaaacaagggacagagcaaacaagtagaaaatactaatgagcaataccaataaataaaagcaaacacaaacccgaccaacaaaaactaatgaccccaaatgaagattgtcctaatgaaaatagatttttcatcaaaacttatctgccctgtcccttttctgttcatgtgctttcaaatgttattgttatggttgattggtcctcacttggccatcatgactttgacaaactcctcgtagttgatctgcccgtcaccgtcaacgtcagcctcacgaatcatctcgtcgacttcctcgtcggtcagcttctcaccgagattggtcatcacgtggcggagctctgctgcagagatgaaaccattctgatccttgtcaaacacgcggaaagcctccttcagctcctcctctgaatctgtgtctttcatcttgcgtgccatgagattgaggaattctgggaaatcaatggtaccattcccatcagcatcaacctcatttatcatatcctgcagctcagcctcagttgggttctgcccaagtgaccgcatcacagtcccaagttccttggtggtaatacaacctgtatcatttggaaacaaaagaaaaaaagttaaacacaaacaagaaattcagcctcacaaggaaatgcatgatccaatttaagaatcaatcaagtgcatgtttggaaactcatcacaaagcaaaatattatgtcaatttagttagcttcaggttggaaacacacattaacaacatgcaaccaaacacgttataagacgaacacttagatctaaaattttggttttctgctcaaatcatattcccaagtttcgttcaagagcttcaaacacatcaacactaatgacgggaatgtgaacatggggagtggtatccataatattccaggttaatatgatcttttgtctacaatttcataaatctataaatgtattataacgatacaagactcacaaatccagtactatgggggaaaaaaatcctttccattcattataaaccacgcacaactcaacaataatcaatcataaatcccacttccttattctgataagagattcacataccatgcaattcttatttcattctcagatatatcttcaaaagtaacaaatggaaaaaaaatgcagtcaataaacataaagggggtcaatcctatacgagtaattatataaacatacattttcatatttccaacccattttcttcctatctctttatttcccatcatatcattatcaccatctcttcctacctaaatccacctaaaagggggggtggaaatttatatttttccattctatattaagttatttacaaatccaaacatgtagcaccaaatgtcacatccacacaaacaattccgaatttctgatcgagaaatcaaacacccacaaatcaaatctggattcacagttgaaaacattcaccccaaccaaccccacaatcctagaacaggaaaaattatcacatcacaagcaacattagcgaagggcaaaacgggaaaaaaggttggatatttcagcgagaatgcaaatccaattcattcataatacacccacaaacatcaaggagcaaaaagtgaaaggagaagacacccaatgaggaaaagattaaaaattcaacaaaataatcaaaagggtaagaaagaaaacgagattggaatgagatctaatgataagagggagagagagagagagagagaagggatctgagaaaagagaccatcgccgtccttgtcgaagaggctaaaggcttccttgaactcagagatctgttcgtcggtgagttgatcggccattggaaattaattgatcgatggatctctctctttgcgatgtgatgtgatgtggaaaaatataaaaggaggactatgttatttatatgctcttacaaacaccaacgaggacttctcttttctttttatggtgtacttaattccttaattcaaacataatctagctgtcataacgccaaattaatgtattattctctaacaatagaaccaacaacactagtagtaaggtctacacaaaattacaatggtacttaactctctaataatatgtgcttttgattctttgtttgatgttttttaaaggaaataaaaaaagtaaatactagtttatacactttttatatggttggttaatcatgtaagaatgtaagataatttgttaattttataataattatttttaaaaaaataatatctattgaaatattttattggtgaactgcgtaatttttttatgctgataatgcataaaaaataaaatctaaaatgaaacaaaattgaagagaaagaaagaaagaaagagagcagagaaatggagaaactcgcaaattcattttcagtgttagaactcgacgccgacgatagccatgttcccaccactgccggtacccttttctctcttctctctcccattcaatttccacctttccatgcgtagttgatgaactttgggttagggtttcacacctgttcattttgttgctgatgaatttttaattttattttttttattgaattttgcgttgaagtgtgtttaatatcttgcaagttggtcgttcagtgcactgctccaatgctagagtgtatcacagagacagagtgacaaaacatcaaatttttaaatataaacgaaaataacgatgattcaattctaatttatagtgtcttcactttgttgaatatgagtgcttctgctgcaacaacatgaaaacacattgcaaattttaagcataaaaaataaaaaacacaacctttatctatttttctatccctcccattctttctttctactattatggttatttttctctgctgtaatctaatcttcatagctctagtgcagccactgaattactacttctatttttattttcttttgtgttcaatttttcttcttttgtgttttgattcttgtgtttgagaaactcaaaaaataagcttatacccgaattaacaaaaaataagcttatgaatcacctcatgctgatatcttctgtagtcaacttgttgttctccatatttatttgtactaactagttacataaatatcctggatggatgtttgctacggggaacattatgttgattactatgaagtgaactagcagctaaaagatactttcatggcgcaggtagtagtgacaagagggttaatgccgacattgacattgtaccggtaaaaagcaagaaacaaaatcaagaaaatccagtgactccttcatgtgaatacaagttacctcttgtgtggattgacttggaaatgactggtaagcttgtagaatgggttgtttggagtgtgttttgcttgtttctatttagataaatatttttcattatgtttttctttgtgtttggtttgtcttgttctcgaatctctaaatctttcagcaacaaagctcttacattttttgatattgtaccaatacttgtgttaacatggctctacatctaaggtagaattatagtaactcaaagtgagccttcttcctagcaatttggataaactttatgttttggaaacatgtgctctccaaggtgaattattgtttagtattctatccttccgaggattattttcttaaaaaaaaccgtgttataattagcagtccctctctctatttcatgcttttaaatgctttcttgaaacctttgctattgttgggcttatcaactttagttcttgacctgctaaaggcatgtctttttttgcttgaaggactgtcagcctatgatctgaatgttatttggagttcatcatctgcatgcaccctcctgattttgcttataaaatttcactgctagttatcatttctccattttgtaaattttatccggtagaatgcatttctaatcctgcctctttaattgcacaacttctgtgttatgcaattttctccttgttgacataattagaaatcttacattagattatctattgttgttgtatttactattttgtggtgctcaccaagtaggctatatattctttagtcgcaaactatgttactgtcagttcttggataacatttgaattgtttagtgcctgatgatgatgaatgttgaaccttctctgtgtgtgcaggtttaaatattgaagtggacagaatattggagattgcttgtataattacagatggaaatttagccaaaacagtggaggtatttaattcaatgttataatttccatgctcattttttgttttcgacttggtcgtttccatgcttcactatattttaaatgagattctacattctcccgtctctagctaataacattcctctttcttacttttttcccctctctgttttttatatggaaaaaacttgcttattccatagactagaacccgtcttactcgacattttgatgcttgtaagcgggaaattatttagagttttttcctatctgcatatcatactaagcacatggttgaattttatttgaaatcaaaaaatttgatgggtgcttcaccttatttaatgaatctcccctagttttgcagttttcaataaattgtaatctatatgagagtgtgtacctagcactccgcttaaaagtaaataggtaatctagtacgtacgatcacgtaagagtgtgtatgaaagaaagtatctgctatttttagggtcctgatttggtcatccatcaaactaaggagtgccttgacgggatgggagaatggtgtcaaagtcatcatgcagctagtggtaagtggtaaatgttgtattttgatactttaatttttgttaagagaaaaaaacattttattagagagatggccatggggagtgtaagatatccttcaaaatagataaactaatttaataaattatagaatatgaagaaatttgagactatattattcatgagttgctgattggttgtttttccttaacattatttagttcacttttatttccttttgaattggattttaaatggcattgactaacaatttttcaataaatttagggttaacaatgaaggtgctaaaaagtacaataagtgaaggagaagctgaaaagcaggtttgtagtaaatataccatgtggcatgtggcaagctctcttttcataggagcttactttctatcaactatcatgttaaatgggtactgtattttctatattcaatgaacttgaaaaaatgttatcctttttatagacatatgaaatagttaaacttgtctattagggattgcagaatcttagtatatggaaggaaattgaatttctcattatccatcacaaatttcataaaaagtatttgtgtggcacattatatgtcaggaaagtttttggcagctgagaaaaaaaatttccctaccagaaaacctgttcttttttctctaaagattcatgttactggcatgaacagttgaaataaatgcattttaaattttacttaaagagtgatctggtcattgtgtaacttatataatatatttaagtagttataacttataaggctatacagttatcagcagatcgctgctgtttcccttcttctaggctggtgtttaatgtagcacaaatggtttcttatgttgtgatatcaatgtagtgacgtgtctagtcttttagaaccacaccccaaactagttattgtagttgaaggacctaaggccttatgaaacccatacttccaatcatacttattaatagcggcgctattgcgcgctttctaggagtagcggtgcagtgcgacgaccggccgccacagaccgcattgcgacagtgagactgagggtagcgctagtagcggccgttatcgcgactgagttgcggctgaaaagcgccgccacaggaatctaagaaaacgaaatacatcgaggaagacgaaagaataaggaagaagaaaggttgagggtaaaactgtaaaatgactattttattcctgaaatctcttttattttaacatttaagagaggtagaagtttaagtaatagtaacttttaagaggtaaaaccgtaaaaaatttaaatctctatgattttcaaagagataaaacagtaaaagtaaaagtttaccttattttaagcaaaaaaatccaaacgtctatttaagtaatgagaatactactaggagaatccaaacgtcttatataaatccttatcacccaatattttcaaaattcatcctcaatcctaatcgtcccatactttcaaaaactctcatctcctcctcttccaaagcattcaactttgttgagcaacactggttagttttatattatatttttattttatcagcaattttttttcttttttttttgtattaacactttgttgagcaacactcatttttttttattatatttctattttttatcaacactattttattttctcaacattaatttttgtttttgtacctctgttttatacttttatgtttgatatttatgtcatattttttttggaggattatgtttgtgaagtttatatatataattcattttagaatatattcacttatatacttcgctgtagcggtctactgctacgtgctatagcgctatagcattttttaggggtggttgctatgcgccgctatctgagattaataagtatgcttccaatgcaggactcaagtcccataccttgcaattggatcctaacacaccaaaaaccaataagttggtagtaaacaaaactagtttgcatttggcatcctagtcctgcatcaagccaatgatatcagttccagtcatatgggagtagtgcttgggtgacacccatgtcatatttgcttgttgtgttggaagtgtccataaactgatatcctttttcctgtatattgccacttgatctgtgatgaactgaactattgacgtactacttttggtctttactggaatgcaatgaccgagtctctttccctttctttgttctattcatttattctcttttataatgaaaatctgtaatgtcttgcaaaattgcaggttattgaatttgttaagagatatgttaatgttggttcgtacacacctctcttggcaggaaattcaatatatgttgattttcaatttctgaaggtattggttctgccatagtaacttgtagaaagtggctctgctgaagcatcattaatttataaattctaattatcataatgttgtttgtctttatagaacagatgtattcctcaagtctcggtttcttttgttaatttctgctgaaaattattggtcacatcgcataatcaatttttttttataaataacatcatatatcaatacaacaatattgggtattgtttatatttcatgcttgccaagtgatggtaattttgttggtcaacacatcataacatttatgaagttggacatctggtaaaagatcaggttgagacttgagacactgatgaaaatttatgtcatctgaatatagaatctctatttttttagaccagttccccttccattctgcatatcctgatcaagccttcttaaaacatatactgctatttttatttggtaccgctatatttcctattgttcctgtttgaaatgttctggttctgtcttaactagatcattttttgcagaaatacatgccaaaattggcaagtctcttctctcatgtacttgttgatgttagtagtgttaaagctctctgcattcgctggtatcccaaaggtgagaaattatacaattagtatataattaaattttctttggtattagtgcattaaatcatactgaagtttaatatttgttatgaactatcaatcacttcttgatcccttaaggccttaatctctgccccataaccatcttcacccccataaaaagaaggaattgttttgtgcttgagattggtggtcagttccagtgcctatcactgcattgtttttactggatctgttatgtaaacatgattcttctagtttttttggtgctattcatgtaatataggttagctccatttggttgaactggtaagtaatatgataaaacatctcatttctatcagaaagttttcaatttccagtggttatgatttatgaattaataatttaatatggccctttttaaaccaaaatataaagaattccttctgtcagctgtccttttgtgtcaaaattctgattgacttcctagttttgtttccctacattttctgcaagccatattagtagggcaactttaacacatggatcagaggttttaacatgactaccccttcttttgtatttctgaccttggctcaacatcccaagggcaaaatacagttgagaaggtgaaaattggaaagttaccaaaaaagtgatgttttaaaacttacacaagattatggacatgctacccgtctcctcaaaaacaattcaacttatgaacaaatatacattctatgctgctgttatttagaggtaaaatcccttagtttttaagggcctatgactttagatatctatgtaatagcgtaaagatgcttagaaacttggcaaggtaactaaaggagatgcttgttgatatatttgttgttagttcttttgatgttttaactttgaagcttggaatctcaccactaccccttttgctcttggacgtcttgatcataattaatgactatattttacttacaaatattctttgcccccaattgtaataatacacggtaaccatttacacattccaaagagacgagaaacaatggatatataagtacttctgggattttgatccttgtttttacttgatttttttataattataatcattatgttatttcctgttttccaaggggagctgttgactaattattaattaatcaatctgagaaagaacttcagatatgcctgcttgtaaactataaaggcttatcatttgtgcagatcagaagagagcaccttcaaaattaaacagacacagagctttggatgacattagagaaagcattgaagaacttagatactacaaggcaaatatttttaagcccaagtccagaaagtcatagggatgcagagaaatcagcgtaagaatgatgggcaggttttcaggtcaagtgtaaaatcttattacaaatatctatgatccatattcgctataaaggaccagaaatgccttgcttacgttttctgttgaggtctatcctgtagaggtactccaattggatcagtgatcgatttctaattgttatggagggtttgcgctgagtaaatggctcgtgattttggataaagtgtagttactgcaaaatcatctttaaatttgtactgaaaaccatgatgtgcaagttaaattgagcttcaactccattgtccattaaagaaagaaaaaggaaatgtaaatgttgattacactacccaaagaaatgtcatgtactaatgttttgtttggtttcatgttgaataattaattcttagtctagaattgattttagattaattttcatatgtttgattttacattaaagaagatttcaaagttgattttggatttataattaattttaagttgaaataattttgagtaattttgtgttatatcaaaaaatttatattaaattttatttttaacttgattttataataaaaatatttaaatataagttatattatttataattaattttgaataaaattaattttattcaaaattaattttgtcaatgctaaaaacaaggagcaattgtacattatatatgtaaataacatgggtaaaagacgtttggacaatgagtagtagcatgagtaacaatcacaccaaataagcatgtatactaactttaaggtaacaaacgaggacatgaattatagtgttggaaatcacaatggttattttcatttgccagtttatattagaaccaaagtgcgggaaagaaaaacaaacaaagagtatagaaaactctacaaatataatcctttcataacctcctatagtattacactttgaatgttatgagcctgtgaccagtaactttttttctttctgaagtcctagagtgtcaaccattaaaaaccagtccatccaacacagatgagtagataactttatcaggggaacaaaggtcatccacaaagaaattaattccatcagtcaataacacgcctgcactgctttgcagctgatgtaaacattgtttacaatactattacctgtcattttctacttcctatctttatattggacttcacaaatgcctgctgagattctgtaaaagtaatttcagattcctttttgtagtctcgtccccagtaaaaccaacaatatccttgctaatattctgcagtgatacagccaaaaatcaaataattagatggggaaatgaaatactattcataataattagatttagttattttgccacattagggtcatacctcaatgttcttcaaggtaaaactaattgtgtttatggacttctgaaacagttcagtgttctcaggggtcatgatggatgaatgtacccttctgcgtacacaaagggtgatttctgttagtcattatacttaagaatgttctgagtgtaaaattaaagagtacaaggaattttggaatcagtccaattctgtctagtcctaatgggcaaaagcacacattctggataaacataataggtgaatgcttttcttatttactagagagaataataaggggactttatgatcaatttcaatttatagggtgtgcaactgaaacacaagaaacaagttacgacatcatttttttgccgttatcccatcaagtctccctcaatcagaatataaaatgttactatgttagttggcatcccctacactaatgggtaatgtcaatgtgctacatggcaatctgaatataatgatgcatgcaagccaaattggtgatagacaagagccatagaagtttaggcaattaacctcaaatcatcagaagcttggataaggttttgggttaaattctcaacttccttcaacaggccataatcacggacttcagccaaccaaggttgaacatcttcagccatggctttgatctgagccatcaatgcatgacagaatgattgaaaataaaaaagaaacaaacaaatacctactgcatagagatgataaacgaatgtcataagggtactatacatgcatattcaccattattattttatgtttttggagatagaagaaactaatatttcatttatcatcatgaactaatctatttttctgttggcaagaaaattgtttgatccaaaggttcattcaagagcactacacctgtgtaagaagtggtttcgcttcttcaataatggaaaatactcgttgagccattgtatagctattgatgataccaattttctctatctcgagaccaagccggatgtaaattccaatcaatgtatccaaacttgttccttggtcaccattgatcttttcgcgatcacacacaataagaccttccttagtacagtcttggtgaagagggccaacagaaggtgttggaattggctcacgaggagtgatgtcaatttttgtttccataagaagaccggactggttaaccatgatcaatgaatttcgcggtataactgttttatcgtcaccaacctgcaaatggaaaactggtggtttaataaaacaattcaacaactaaggtcctacttagataaacttcaccataagcacttactcgagaagaaaataaaaggtaaacagagtcgagttttttccatcagctaaaatcaacttatgcacttcagcttttattcagcattcacagcagaaacataatcttattttcttctcctcttataaatgtttatggagaaatttatacacaagcgacgttaaacagacaatgtcaaacacaagcaagattttaatccagggatactaaagtgctcaattaaagaattgaaaggcacctcaacaactacttcaatacttttcaaggaaggattcacaccaatgacattgccaacagtggcccctctgattctcacaggcgttcctttgcttatgccacaagcttcagcaaactcaaacaccactgtgtacttccggaatttggatctgatttggaagcccctcaaccaggccaagctaagaacaaataggacagtaccagacactagaaacagtccaaccccaccttcccagatgctcctatcattgaaccctaaatcacttaatggccgcaatgtttgcctccaaacggcccatggaatgtttgacaaagctgaaagtggtttctttgcttctgaagaagatgatgatgacctttggccatgacctgaatcagcagatgtagctcttttcctgttgatttgtgtctggcgtcgaattggaagagggatggaacttgaaggatttcttggcagggtaatcagagatgaagaaaaagaagttggcaatgatgagacatggagtgcagggttcccaaccatcttctcaacaacctcttagccctgaagttctatcatccacacagacacaaaaacaaacaaggttttaagctacatcaacaaaccaattgaactagaatcaaaatcatataaatctaatcagcaactaataatacacaattaaatgacaacaattaaaaagaacaaaaaatacaaacacagaaggcacaaattacatatataaattccattgattctaataacatcagaaaaatcaaattggttggaaatggacaatgcaggggatatatagttatatttcaagcgtaggataataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaacagacttcaccattccataatgtgaatattattgcagaaatggaaagttagcaatttgagggtagcataatattgggtttggcttggttggaccctaaaccgaaacctaacaaaaacgaaataccgggcaacacgtaaaagcgcttccaatatgatattcagcaccaaaagataccattttttacctaacaagcaagtaaagtagattgaaggatgaagaaaatatttcagataaattgaatgccaaataaaagtctcttgatggtggaaaaaaatgactaatgttgggtccttgaaaacaagtttgagtgacagtgtgacactgttggcatcatcatcaaacaaataaaagagacattatcgtagtgtgaatggaagagacagaaacctatgcagcatgaagtagcatggacatcaataagagtgaggcatttcaattttaacgttctaagaaattgttatatacaacaatttggttaaacaagtaaacgtatcatgaccaatttgttttttattttatttatttttataaagacaatttgtttttcttttctagaatcatgaacaaattgttattaataaataataacactctttattgcatttatttatacaaaatttcatgttaatcttttttattaaataaatttttaaaaaaattagtggaaaatattaatttataatgaagtgtttaaaaaagataccaaccaagtaatgtattataattattttattaggaaaactacgtaccttattttgtcaaataatcgcttatgtatgtcatgtaatttatcttatacattgtcatttaataataaaatatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatgtaattatgagacgagtcatgatacaatggtaaaattgtgtcttaacgacttattgatcatgagttcgaatctgaaaacaacttctttgtatatacaagaataagactgcgtacattatccctcccctttaccttcgcataacaaagagcttccggacaataaggtacataattttttattcaaatatgtaattgtgtaccaacacaaataggaagtataaactaggcagaaacaaattattggtataattattaattataaaaaaagttgatattgacaaaatgaaaaacattgatgctcttattcccatccaactgctgatataataagcttctttaattatttttaaaattgaaaatagaagagttatctttgaagtggcaagcagtaacacaattaagcaaagaaggggacagaaggataccttatggaactctagtgtatctccttttgccttccgtacctcaaccatgtgaagagaaggtgccacttggaatatctgtttatgattaggtacttttgaatttcagtacaataatgtgataaatagtgtcccacatcaccaaataacaaaacaaaaaaatcatacaggtttagttaatcatttggtcccctatacttaccccaacttttcgctactttttagtccttatatgagcaattttgttttatgttttagtttgtgttaggtttttggcagtgtaaaaccactaaaaatagagacataaggactaaaatttaaaagagattactcgtatagggaccaaaataatgagtttttatgtatagggactaaaatgaaaagttgacaaaggtacaggaaacagatgattaattaaaccaatcatatacctctgtggcaacattaaggtttcccttccttccagctttcacatttgcaagcctcatctgcaggaggtgatgatttattaattttacaaacaattatttaatagaaagtcccctctgagtagaagcttgtaatttgtcaaggggataggtttaccttgtaatttttcttctgcacatcaaagccaagaggttttgcagcttcctcaatcttgttgattatctcatccgcagtggatt

SEQ ID NO: 7 - DNA, 2560 bp, Glycine canescens
atggcggatgaagggggaattgcgaagtggcgctacgatgtatttctgtgttttagaggggaagacacgcgccacaccttcacaggtaatctctatgctgctttgcggaaggcgagattgaggacattcttcgatgttgggttgaagggtggtgaccaaatctttgaagctattgttcaagcattggaagcatccaggatttcaatcgttgttctctccaaaagcttcgcgtcttcctcgtggtgccttgaagaacttgtcaagatccttgagttaagggcaacaaagaagcaactagttattccaatcttttaccacgtggatccctcccatgtaaggaaacagactggtagtttcggagagtacctgattagacatgaaagtcgcttgggaaaggactccgagaaaatacacaagtggaagtcagctttgtatgaagttgccaccttggccggatggtgtttcggagacggaagctgcaggtatggcgttttttcttcttcttaatttagctagtaccgcttcttaattttaaaaaaagaaaatgaaaataataattttttgtaggcattcaatactgccttacactttgagagaaaaaagaaacacagaacaacgtgacattaataagagagataatgaaaaatataggtgtaaatatgtttttaatagtttagtgttttttttttaatttttgtaatttttgttatttttagtctttataaattatatatatatatattttacttttagttttaaaattactttaaatagtactctagatagtaaaaaaaaaagtcctataagaaccaaaataaaaataaacattgtttgtaaggattaaaacaaaaaataattttataaaaacaaaaaaataaatattaaattataagaattaaaaagatatttaagttaaaaataaaatgtttcgatccaatgaatttttagcctaggatggtgtttatgtatcattgttgaaattaaaatttcatatactaagttaagtaactcatgccgattattattgctgaagtcatgtaaacttgcattttaatcctcaaagaccaaaaccacttgtgatatttgcacgaagcttttttccttgatttataccttattgaatattctaacttctgagttgtcaaatgactcgttaacatgggcttgagccagtttatgtctagaattgcaaggctttggccaatattcttaaagtgacaatctaacgtaactagttaattctcctttcattcttaaaagaaaaacaaaatagaaaccaacaataattatactctttgataaggaatttgttttatgaattatcacactagaatttattattggtaagaaacaatctaagcttttagctaatttatcaagttaattttactttgttttgacttacgagttttaaggtttgaaatctttggggagattaattattcaaactcaattttattatattaaaaaaaattcttttaagcactctttattaaaattataaaatttatagatctcactttttacttaataattttcattcataatttttaattaattgtaagaaatgtgcaagtgtgtgagagagtttcttgcttgaacccgtcttaaagtaatcaataatagataaagaaaaacgtaaccagtgcatgaatgaattaaaaggtcatgtacttttttgtaggtaccaatatgaatatgaattcatcgaaaacattgtgcgagaagccatcgccattgtaccccgctatagcatttttctgagttttagtggaaacgatacccgctcctttacaggttttctgaacaatgcattgtgccggagtaggtaccaaaccttcatgaatgatggggaccaaatttcacaatctactaatggagttattgaagaatcaaggctttcgatcattgtattttctgaaaactatgcacgttcctcgtcctgtcttgatgtgcttttgaccatccttcagtgtatggagacgaaaaaccaactgatttgtcccatcttttacaaagtgttaccgtcggatttaaggcatcaaagaaatagctatggtgaagccatgactgagcatgaaaatatgttgggtaaggactctgagagggtgaagaaatggaggtcagctttgtttgatgtcgccaacttgaaaggattttacttgaaaaccgggtacaacacatattattcttttactttttgcttattttcatgattcatgtctattatactagtaatagttgatgataataatcacttaatatgtgcatcgttcttgaaattctatgaaccgtttaatttgaaatccgttcatttaaatttgactttgttaacaaggaataacgttgtgagagacattggggtacggagttaaggctttgtttagagtttgcaattctgtttttgttgttgtgtggtaattacttttgtgcggatttactttgataattttagaaagaaaatgaaaattgtgtatgaatgaactaaaaggccttgtatttttgtaggtacgaatatgaatttattgacaaaatcgtggaaatggccagtaaaatttaa

SEQ ID NO: 8 - DNA, 1023 bp, Glycine canescens
atggcggatgaagggggaattgcgaagtggcgctacgatgtatttctgtgttttagaggggaagacacgcgccacaccttcacaggtaatctctatgctgctttgcggaaggcgagattgaggacattcttcgatgttgggttgaagggtggtgaccaaatctttgaagctattgttcaagcattggaagcatccaggatttcaatcgttgttctctccaaaagcttcgcgtcttcctcgtggtgccttgaagaacttgtcaagatccttgagttaagggcaacaaagaagcaactagttattccaatcttttaccacgtggatccctcccatgtaaggaaacagactggtagtttcggagagtacctgattagacatgaaagtcgcttgggaaaggactccgagaaaatacacaagtggaagtcagctttgtatgaagttgccaccttggccggatggtgtttcggagacggaagctgcaggtaccaatatgaatatgaattcatcgaaaacattgtgcgagaagccatcgccattgtaccccgctatagcatttttctgagttttagtggaaacgatacccgctcctttacaggttttctgaacaatgcattgtgccggagtaggtaccaaaccttcatgaatgatggggaccaaatttcacaatctactaatggagttattgaagaatcaaggctttcgatcattgtattttctgaaaactatgcacgttcctcgtcctgtcttgatgtgcttttgaccatccttcagtgtatggagacgaaaaaccaactgatttgtcccatcttttacaaagtgttaccgtcggatttaaggcatcaaagaaatagctatggtgaagccatgactgagcatgaaaatatgttgggtaaggactctgagagggtgaagaaatggaggtcagctttgtttgatgtcgccaacttgaaaggattttacttgaaaaccgggtacgaatatgaatttattgacaaaatcgtggaaatggccagtaaaatttaa

SEQ ID NO: 9 - DNA, 2505 bp, Medicago truncatula
gttgccatcgtttcatcctagggttttattgttactgttattggcaattagatatctgaaatttggtggcatgcttcagagttagaggatggagttttcaagtttttttggtttttgtttgatgatgttctaagttttttggtttagcttttgctggtctattaatggcatgatgcttcactgatgacaaataacaatgtaatgaagtgtcagttttgattttaagccatattcgtgtattgttaaagcatccaattttgtcaatcaattgatgcttcaagtatttcttttattaatgcaatgaattttcgttttaccttataatccatatgagaactttctttaattttccagttatgtgtatattgattttgtattttgttgtaaagaattaatcatagtgcactgaacctagcaaaacttgggaatttgttgatattgaagctaatttaatcaatagtcttgcttaaatggaataagaatggcgtggtactcttcaaaatatcatgattgcacatttattttccctttaccgcttcacaacatttaattcagcactactatcaattattctctatcaatgcatattcccatgcaccagcaaaagtatgtcatgtaactataaatataggtgcggtgctatcgaaaggcttgccattctcattctaaactcacttagcatcacatgtttgtatcaaaaaatggctttacgtgagtttgagagcttacttgctttgatttgcttgaaaggtcccataatctttgtttattatgtttatggtttatttttatgtgaatatgaaaaccatccagcatcaaaatctaaacgaaggaccgcatattatttaccatcatttttaccaattttcattctcaacaacaccattatttacccaagaaaataattaaacaacaacatattattttccgccaaccgttgctttttctacggacacccaaatgtaaaacacccttaattccaaagatttccaagatataaataaatacaccataaacattcttcttctaacaaagaagacctaaccattgttctaacagtaacacctaaaattcagttacctaacatgtcaaagtgaaaactgagcacaaaaactaaaatcaaaacaccagttaagaaaataattaaacaacaacacaaaattttgcattttgatgtatgaaaagctttaaaaaaagtgactatttctaaaatcacttttaaaaaaagaaacatccaaagtcatgagtgagtcaaaggggttataaacttctgcattaccctaatctttctattcttgaaattccatgagaaaataaacaacagcacataaatgggttaagctttaaaaaaagggataatttgtaaaatcactttttcagacatttttgtttatgcatgtggtaaaagtcatctaaagaacatccaatggaagaatcgtacaaaaaatcattgatctaacagaatggaccaaaacgagattaaaaaaaaacttaaatactcaaacaatcctttttttagttaagaaattaaaacaataccaattaaatatttaaggaaccaaaataacatttaagcctaaattattttgactaacataaatacataattaaaaactattttaaaatttcaatacaacgacacaccttgagagactaaaatgattattattcatattatccattaaaaaggaaaaggagtgcgtgtgaaaagcaggccacacgtatatgggccttgaactcgaattcgaattcgaatcttgtggccacctaaccacttcactaaactcacgaataattggtgaacaattctttacaacgaaactaacgaatatcctaataccagatcctaatgacatttttacccctaaactcttaccctcaacactttcaaaagaatcatcactaaattgtcattttaacacactctagaacctactttgataacgaaaaagtagaaagaaacccgtgctaggtcccacccaatagacaacgcaaaccacaattaccagcgcagtatcacgggtcatgcaccggtcacgtagcgtagataaaacccggaaccaaacttgacctacccccacaaacaagtcattattttattatatttatccttaaaaccctatttctcatttcatttcttctacaaccgtctactctagctcgttagttccgctatcactctactcttctactacttcacttcatcctctttgtttttcagcctagggtggtggtaattattcataactgtttcattatttttccttaatttctcattaattttccgttaatttttcaattagtgtaagctgatctgatttttttcctttgtttttgtttcgaattttgatggatcagccaagatcaagatcgtaatcaacggtaaatattatagttccttcgatctctgttcatttatgcgtcgatcggatttatattttttaatttagtttattttttgttaattttgtttgtaactgataggatttggaagaatcggaaacc

SEQ ID NO: 10 - DNA, 1000 bp, Medicago truncatula
gctgtttcattactgtggtagtgctataaattggcctactttttgtttcttacagtctattagcctagcagccgttaggcctcttttttaaatgtaataagttgaattcctgaactcgtgaagcttgccccttattgaaccgtagtgtttttggttgcttaataccattaagcaatgagttgttttggatttatatgcatttaccgaattttatttggatgatagtaagcgttttttccatgttcacaaatatgccatgaaaaaagcagtaaaatttcaataaaccaacatcatgataaaacaaaagtatgcatcgtatgaaaaaaagtgggtgatgaaatgataagtctaattttggtcgaatttggtcgttgttatttttgcatgaacatctcttttgtacaacctaacaacttatttgctatttttaatatttttgtactgcttttgatttgcttgctcttcacaatattatagtgttgcattagttgttcaattttggttgtacaaataatacaacttttaagcagttatcgtgaatgttagaaaaatcatgtgacttatctctgttattgggtgattgcatttgtttcgtgacttgtctttaatcggttacttattttcaataataaataacaatatagcattattttgtgtcactttcttacttttgattattgaaaagccgtgctcctttgcctgtctcttgagccatgtgattcgtcgtgaattgtgaggacgagatcatatttgagaaagaaaatgtgagctagacgtttctatagctttattacgtagcccttgcaattcaattcagcagggaacatatcaaaatgatttgtattgaaaaaattgttctacctacaaaaatctactttattatttgtactgaacgagaaagtgccacaatacttaattagataagtagacattggagctaatctcaaaattcttgcctgctttttctatcatatatctccatatcactaatgaattcatt

SEQ ID NO: 11 - protein, 340 aa, Glycine canescens
MADEGGIAKWRYDVFLCFRGEDTRHTFTGNLYAALRKARLRTFFDVGLKGGDQIFEAIVQALEASRISIVVLSKSFASSSWCLEELVKILELRATKKQLVIPIFYHVDPSHVRKQTGSFGEYLIRHESRLGKDSEKIHKWKSALYEVATLAGWCFGDGSCRYQYEYEFIENIVREAIAIVPRYSIFLSFSGNDTRSFTGFLNNALCRSRYQTFMNDGDQISQSTNGVIEESRLSIIVFSENYARSSSCLDVLLTILQCMETKNQLICPIFYKVLPSDLRHQRNSYGEAMTEHENMLGKDSERVKKWRSALFDVANLKGFYLKTGYEYEFIDKIVEMASKI

SEQ ID NO: 12 - DNA, 1730 bp, Glycine canescens
atgtcgaatgaactcaaaaactacgatgtttttctcagttttcatggcgaagattcccgttacaccttcactggtactctctataatgctttgcgcagcaagagaatcaagacctttttcacagaacatgaatatgatcgtaaactacacactcatgacagccaaattccacactctactcttgaagcaatcaaggaatcaaggatttcgatggttgttttctcggaaaactatgcatcctcctcaagatgtcttgatgaacttgtggccatccttgagtgtaacaggacgataaaccaactggtgtggcccatcttttacggagtgtatccgtggcaagtaaggcaccagggcggtaactatggagcatctatgtctaaattagaagaaatatttagagattccaatgagagggtgaagcaatggagagcagctttatttgaagtcaccaacttgaatggatggtgttaccaaactgggtatgcttaattttagttgattaagttccattattaatctctacaactgctagcatagcatggcaccacttctttattacttattgtatctgtaatctgctgaacagtatgtctgatcttctaattatcgttttagaaagtcactttgttttgtttaaccgagagaaatacatgtgtgctgtaaattaaaggttctgtttccagtttcagtgtagcagtagcaatctgttctgtgcatacatatagattagtcaagcttaagtcaacttataattctgattaatagaaacaatatggttgtccatgctcgaatacccctggtgaattaaaaagacttgtgcttttataggaggtaccagtatgaatatgaattcatcgaaaggatcgtggaatcagccgtgcaagccttgcccggatatgatgtttttctgagttttaccggagaggatacccgctatactttcacaggttttctctataatgcctttcgccgagagggattcaaaatcttcatggacgatgaggaattggagagtgggaaccaaatatcacagaagcttatgggagcaattgaaagttcaaggatttcaattgttgtgctttctgaaaactatgcatattccacgtggtgtcttgatgaacttgccaagatcattgagtgtatgaagaccaacaatcaaatggtttggccaatattttacaatgtgcaaaagtcggatgtatgcaatcaaacaaaaagttatggtgaagccatgactgaacatgaaaaaagatttggaaaggactctgagaaggtgcagaaatggagttctgctttgtctgaaatcaacaatttggaaggagaccatgtcaaagaaaatgagtacgtaatgcttttaattagttacttaatatatgcttccctcttaagtgatattgaccatctatgaaatgctaaacatggcatagttcttgtccgagacatggggtattgtgtgttgttttgtttggagcagtttttgtattttgtacggcaatctgttagtgagaagattaattagtcgagcttaatattgttgttttattgacataaagtctgattaggagaaataaagtgaacacagcggatgaatgtcttaaaagaccttgcacttttgtaggtaccaacatgaatttatcgaaaggattgtacaaaaggtcattaaacttgaaggtagcaagcatatagcaaatcctttccttttatccaatgacagctacgaggaagaatga

SEQ ID NO: 13 - DNA, 1104 bp, Glycine canescens
atgtcgaatgaactcaaaaactacgatgtttttctcagttttcatggcgaagattcccgttacaccttcactggtactctctataatgctttgcgcagcaagagaatcaagacctttttcacagaacatgaatatgatcgtaaactacacactcatgacagccaaattccacactctactcttgaagcaatcaaggaatcaaggatttcgatggttgttttctcggaaaactatgcatcctcctcaagatgtcttgatgaacttgtggccatccttgagtgtaacaggacgataaaccaactggtgtggcccatcttttacggagtgtatccgtggcaagtaaggcaccagggcggtaactatggagcatctatgtctaaattagaagaaatatttagagattccaatgagagggtgaagcaatggagagcagctttatttgaagtcaccaacttgaatggatggtgttaccaaactgggaggtaccagtatgaatatgaattcatcgaaaggatcgtggaatcagccgtgcaagccttgcccggatatgatgtttttctgagttttaccggagaggatacccgctatactttcacaggttttctctataatgcctttcgccgagagggattcaaaatcttcatggacgatgaggaattggagagtgggaaccaaatatcacagaagcttatgggagcaattgaaagttcaaggatttcaattgttgtgctttctgaaaactatgcatattccacgtggtgtcttgatgaacttgccaagatcattgagtgtatgaagaccaacaatcaaatggtttggccaatattttacaatgtgcaaaagtcggatgtatgcaatcaaacaaaaagttatggtgaagccatgactgaacatgaaaaaagatttggaaaggactctgagaaggtgcagaaatggagttctgctttgtctgaaatcaacaatttggaaggagaccatgtcaaagaaaatgagtaccaacatgaatttatcgaaaggattgtacaaaaggtcattaaacttgaaggtagcaagcatatagcaaatcctttccttttatccaatgacagctacgaggaagaatga

SEQ ID NO: 14 - DNA, 2002 bp, Medicago truncatula
ccttaggaaatatggtggctgtactcattttgatgttgatgaatggtttaactgaattccgtttattatcatttttttttttttttgtattatataaaatgaaatgtatagagttgtacaaaaaaaatgaaaccagagtttagagtttatcaacatagagccaaaagttcacgcgataggggtcaaaatcgaaatatagtgtgaacaaataataaaacataatgaaataaagcaaaatcataaaagaaaaagataaaataatgtttgtacaaaaaaaaaagataaaataatgattgtagtatctaccaaaaaaataataataataatgatggtagtctctcatctgtttgactgaattaaatttatttgacaactttaaatgagttttttctttgataaaaactttaaattatagtataaataatatattataatacctatacacatatatttaaaaagttaagaaaatgggtagaccatgtcatggtttaaaaataaaaaataatttgacaaaaatcataaaaaattaaataaccaagttaataataacaagaatatttaatcatgattttattatattgttgttgacctattgactaatacatactaaaaataaacacacaagaaggagtatggagacctaaaatcgaactcaggattcaacataaaattgttatagtcaaaccattgggttataacaatggggacaataatgaaaatataaaaatgaaccaaaattataaaacaaaaaagataaaataatgatgacaatttctcatttgtttgattggtttggttttatttgacaattttaaatgagttaaataatatttctaatacatacatattaaaaatttaagaaaattgggtagaccatagatccttccgctttatatcaatataattttctcgatgtaaatgggcattttccctcttttgcacaaaaaaaaaaatctcgatgttacattgatatttatgtgcgcctaagactttacattgatatatttatttggtgcgccttcattttttctatattatatcataaattttaaaaacaaagttacaaacacaaagcgcgccttcatttttctatattatatcataaattagaattacgttctcgaagagtcaaaccaacctactgattacgttctcggagagacaaaccaacctagtgatttactactagctaattttggttattcctcgaaagtttactttataatcgtgaaatgttattctgattttcttttgaggccaaaatcgtatccgactcacgagagattgctagtttttcttttgcagccaaattcctttacattttaacaaaagaattttttttttttggtcaagtagccacctagtggctagagcacacacaatttaattgtggagaagtggagtgtctggggttcgaaccccggcccctgcatataatatgcaatatccctaccaactgagctaagctcacgagaattaaaaaaaaagaatattaatctaactaaatatacagttaagcgcaatagaaaaacagacgaacaaaagaaagaaacgttgatatataattattggagaatgctaaccattgttagtattgaaaaatggtgaaaaatgataaatttaactttttaaaagtcaaaatattattgaaatcaatataaacatactacttttgacttctttaaccattaccagagggcaatggttaacgagacccataattattctaaggagctactttgcagataggggatgtccttttttttttttgttgaaagaaattaggggatgtccttatctctttatccctgccaattttcctatttataaataaatatcgagtttatcgctctccacctcaaacgctttctttcttgttcttggtttagggttttcttcacccattagggttagggttcaattttccccttttcaatccccaaatcaaaattcaatcaaaacctcaaatttctcaccttttctcactcaatcatcaatcaag

SEQ ID NO: 15 - DNA, 1007 bp, Medicago truncatula
gagctctctttatcatcatcaacatcatcgtgtgactttaatcgacccttcattcatggcttttactatatgttctattttgtaatctttttcttttcaagttgtctttttttagagggtttttgaataatttgtcaaatgggtatgcttaggtacttttatgtctttttaatatcaaaatgatgcattttggatatgaatgttgttatgatgctgtctatgaagtggtgctgaaaagggttgttgatgggaattggattcagttgtgctgttattgatttggcccttcttaaaaccttgaatgtaatatattgttccctggatggaggttaatatgatggtgctactagttactactatatcttgttctgtgctctgatttgttgttctgtgatcaaataacttgtttaatccttggatcataagctggcttgagttgttggtttagtttattttttggtatgtttggttttgcggcaatttttccgcgatagctcaaaacctatgctagtttttcacgtctatatagacacgcaacaacacaactgaatgtgagttcaggctcaaacaccaaacagaacatatgctccgtgattgtcagtattaaatctggggcaatgaggttttgtaaaatttctatccggtggcggttaagttcagtattttagtttttgaaagtatatattgaaatctggattgtccgaatgtaacagtcaccagtgtagctcacagtgtaaccttagatgattgtgacccacaaggccacaatccaaatttgttggttttatgatggatgtgtaataatgcaacttttgccctgcatttggtttttatactaaattagtttagaaggataaccaaaagctactaggcagtgatacaatctagacatacggatgttattgatgatatattttacattctggattttatataatctgaatctctattctggagaaatttagccataaagcattttgagtgatcctctgttccttttccttaga

SEQ ID NO: 16 - protein, 367 aa, Glycine canescens
MSNELKNYDVFLSFHGEDSRYTFTGTLYNALRSKRIKTFFTEHEYDRKLHTHDSQIPHSTLEAIKESRISMVVFSENYASSSRCLDELVAILECNRTINQLVWPIFYGVYPWQVRHQGGNYGASMSKLEEIFRDSNERVKQWRAALFEVTNLNGWCYQTGRYQYEYEFIERIVESAVQALPGYDVFLSFTGEDTRYTFTGFLYNAFRREGFKIFMDDEELESGNQISQKLMGAIESSRISIVVLSENYAYSTWCLDELAKIIECMKTNNQMVWPIFYNVQKSDVCNQTKSYGEAMTEHEKRFGKDSEKVQKWSSALSEINNLEGDHVKENEYQHEFIERIVQKVIKLEGSKHIANPFLLSNDSYEEE

SEQ ID NO: 17 - DNA, 20257 bp, Artificial
  Vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggacccttaggaaatatggtggctgtactcattttgatgttgatgaatggtttaactgaattccgtttattatcatttttttttttttttgtattatataaaatgaaatgtatagagttgtacaaaaaaaatgaaaccagagtttagagtttatcaacatagagccaaaagttcacgcgataggggtcaaaatcgaaatatagtgtgaacaaataataaaacataatgaaataaagcaaaatcataaaagaaaaagataaaataatgtttgtacaaaaaaaaaagataaaataatgattgtagtatctaccaaaaaaataataataataatgatggtagtctctcatctgtttgactgaattaaatttatttgacaactttaaatgagttttttctttgataaaaactttaaattatagtataaataatatattataatacctatacacatatatttaaaaagttaagaaaatgggtagaccatgtcatggtttaaaaataaaaaataatttgacaaaaatcataaaaaattaaataaccaagttaataataacaagaatatttaatcatgattttattatattgttgttgacctattgactaatacatactaaaaataaacacacaagaaggagtatggagacctaaaatcgaactcaggattcaacataaaattgttatagtcaaaccattgggttataacaatggggacaataatgaaaatataaaaatgaaccaaaattataaaacaaaaaagataaaataatgatgacaatttctcatttgtttgattggtttggttttatttgacaattttaaatgagttaaataatatttctaatacatacatattaaaaatttaagaaaattgggtagaccatagatccttccgctttatatcaatataattttctcgatgtaaatgggcattttccctcttttgcacaaaaaaaaaaatctcgatgttacattgatatttatgtgcgcctaagactttacattgatatatttatttggtgcgccttcattttttctatattatatcataaattttaaaaacaaagttacaaacacaaagcgcgccttcatttttctatattatatcataaattagaattacgttctcgaagagtcaaaccaacctactgattacgttctcggagagacaaaccaacctagtgatttactactagctaattttggttattcctcgaaagtttactttataatcgtgaaatgttattctgattttcttttgaggccaaaatcgtatccgactcacgagagattgctagtttttcttttgcagccaaattcctttacattttaacaaaagaattttttttttttggtcaagtagccacctagtggctagagcacacacaatttaattgtggagaagtggagtgtctggggttcgaaccccggcccctgcatataatatgcaatatccctaccaactgagctaagctcacgagaattaaaaaaaaagaatattaatctaactaaatatacagttaagcgcaatagaaaaacagacgaacaaaagaaagaaacgttgatatataattattggagaatgctaaccattgttagtattgaaaaatggtgaaaaatgataaatttaactttttaaaagtcaaaatattattgaaatcaatataaacatactacttttgacttctttaaccattaccagagggcaatggttaacgagacccataattattctaaggagctactttgcagataggggatgtccttttttttttttgttgaaagaaattaggggatgtccttatctctttatccctgccaattttcctatttataaataaatatcgagtttatcgctctccacctcaaacgctttctttcttgttcttggtttagggttttcttcacccattagggttagggttcaattttccccttttcaatccccaaatcaaaattcaatcaaaacctcaaatttctcaccttttctcactcaatcatcaatcaaggatccaaaaatgtcgaatgaactcaaaaactacgatgtttttctcagttttcatggcgaagattcccgttacaccttcactggtactctctataatgctttgcgcagcaagagaatcaagacctttttcacagaacatgaatatgatcgtaaactacacactcatgacagccaaattccacactctactcttgaagcaatcaaggaatcaaggatttcgatggttgttttctcggaaaactatgcatcctcctcaagatgtcttgatgaacttgtggccatccttgagtgtaacaggacgataaaccaactggtgtggcccatcttttacggagtgtatccgtggcaagtaaggcaccagggcggtaactatggagcatctatgtctaaattagaagaaatatttagagattccaatgagagggtgaagcaatggagagcagctttatttgaagtcaccaacttgaatggatggtgttaccaaactgggtatgcttaattttagttgattaagttccattattaatctctacaactgctagcatagcatggcaccacttctttattacttattgtatctgtaatctgctgaacagtatgtctgatcttctaattatcgttttagaaagtcactttgttttgtttaaccgagagaaatacatgtgtgctgtaaattaaaggttctgtttccagtttcagtgtagcagtagcaatctgttctgtgcatacatatagattagtcaagcttaagtcaacttataattctgattaatagaaacaatatggttgtccatgctcgaatacccctggtgaattaaaaagacttgtgcttttataggaggtaccagtatgaatatgaattcatcgaaaggatcgtggaatcagccgtgcaagccttgcccggatatgatgtttttctgagttttaccggagaggatacccgctatactttcacaggttttctctataatgcctttcgccgagagggattcaaaatcttcatggacgatgaggaattggagagtgggaaccaaatatcacagaagcttatgggagcaattgaaagttcaaggatttcaattgttgtgctttctgaaaactatgcatattccacgtggtgtcttgatgaacttgccaagatcattgagtgtatgaagaccaacaatcaaatggtttggccaatattttacaatgtgcaaaagtcggatgtatgcaatcaaacaaaaagttatggtgaagccatgactgaacatgaaaaaagatttggaaaggactctgagaaggtgcagaaatggagttctgctttgtctgaaatcaacaatttggaaggagaccatgtcaaagaaaatgagtacgtaatgcttttaattagttacttaatatatgcttccctcttaagtgatattgaccatctatgaaatgctaaacatggcatagttcttgtccgagacatggggtattgtgtgttgttttgtttggagcagtttttgtattttgtacggcaatctgttagtgagaagattaattagtcgagcttaatattgttgttttattgacataaagtctgattaggagaaataaagtgaacacagcggatgaatgtcttaaaagaccttgcacttttgtaggtaccaacatgaatttatcgaaaggattgtacaaaaggtcattaaacttgaaggtagcaagcatatagcaaatcctttccttttatccaatgacagctacgaggaagaatgattaattgagctctctttatcatcatcaacatcatcgtgtgactttaatcgacccttcattcatggcttttactatatgttctattttgtaatctttttcttttcaagttgtctttttttagagggtttttgaataatttgtcaaatgggtatgcttaggtacttttatgtctttttaatatcaaaatgatgcattttggatatgaatgttgttatgatgctgtctatgaagtggtgctgaaaagggttgttgatgggaattggattcagttgtgctgttattgatttggcccttcttaaaaccttgaatgtaatatattgttccctggatggaggttaatatgatggtgctactagttactactatatcttgttctgtgctctgatttgttgttctgtgatcaaataacttgtttaatccttggatcataagctggcttgagttgttggtttagtttattttttggtatgtttggttttgcggcaatttttccgcgatagctcaaaacctatgctagtttttcacgtctatatagacacgcaacaacacaactgaatgtgagttcaggctcaaacaccaaacagaacatatgctccgtgattgtcagtattaaatctggggcaatgaggttttgtaaaatttctatccggtggcggttaagttcagtattttagtttttgaaagtatatattgaaatctggattgtccgaatgtaacagtcaccagtgtagctcacagtgtaaccttagatgattgtgacccacaaggccacaatccaaatttgttggttttatgatggatgtgtaataatgcaacttttgccctgcatttggtttttatactaaattagtttagaaggataaccaaaagctactaggcagtgatacaatctagacatacggatgttattgatgatatattttacattctggattttatataatctgaatctctattctggagaaatttagccataaagcattttgagtgatcctctgttccttttccttagacggacccttaactaagttgccatcgtttcatcctagggttttattgttactgttattggcaattagatatctgaaatttggtggcatgcttcagagttagaggatggagttttcaagtttttttggtttttgtttgatgatgttctaagttttttggtttagcttttgctggtctattaatggcatgatgcttcactgatgacaaataacaatgtaatgaagtgtcagttttgattttaagccatattcgtgtattgttaaagcatccaattttgtcaatcaattgatgcttcaagtatttcttttattaatgcaatgaattttcgttttaccttataatccatatgagaactttctttaattttccagttatgtgtatattgattttgtattttgttgtaaagaattaatcatagtgcactgaacctagcaaaacttgggaatttgttgatattgaagctaatttaatcaatagtcttgcttaaatggaataagaatggcgtggtactcttcaaaatatcatgattgcacatttattttccctttaccgcttcacaacatttaattcagcactactatcaattattctctatcaatgcatattcccatgcaccagcaaaagtatgtcatgtaactataaatataggtgcggtgctatcgaaaggcttgccattctcattctaaactcacttagcatcacatgtttgtatcaaaaaatggctttacgtgagtttgagagcttacttgctttgatttgcttgaaaggtcccataatctttgtttattatgtttatggtttatttttatgtgaatatgaaaaccatccagcatcaaaatctaaacgaaggaccgcatattatttaccatcatttttaccaattttcattctcaacaacaccattatttacccaagaaaataattaaacaacaacatattattttccgccaaccgttgctttttctacggacacccaaatgtaaaacacccttaattccaaagatttccaagatataaataaatacaccataaacattcttcttctaacaaagaagacctaaccattgttctaacagtaacacctaaaattcagttacctaacatgtcaaagtgaaaactgagcacaaaaactaaaatcaaaacaccagttaagaaaataattaaacaacaacacaaaattttgcattttgatgtatgaaaagctttaaaaaaagtgactatttctaaaatcacttttaaaaaaagaaacatccaaagtcatgagtgagtcaaaggggttataaacttctgcattaccctaatctttctattcttgaaattccatgagaaaataaacaacagcacataaatgggttaagctttaaaaaaagggataatttgtaaaatcactttttcagacatttttgtttatgcatgtggtaaaagtcatctaaagaacatccaatggaagaatcgtacaaaaaatcattgatctaacagaatggaccaaaacgagattaaaaaaaaacttaaatactcaaacaatcctttttttagttaagaaattaaaacaataccaattaaatatttaaggaaccaaaataacatttaagcctaaattattttgactaacataaatacataattaaaaactattttaaaatttcaatacaacgacacaccttgagagactaaaatgattattattcatattatccattaaaaaggaaaaggagtgcgtgtgaaaagcaggccacacgtatatgggccttgaactcgaattcgaattcgaatcttgtggccacctaaccacttcactaaactcacgaataattggtgaacaattctttacaacgaaactaacgaatatcctaataccagatcctaatgacatttttacccctaaactcttaccctcaacactttcaaaagaatcatcactaaattgtcattttaacacactctagaacctactttgataacgaaaaagtagaaagaaacccgtgctaggtcccacccaatagacaacgcaaaccacaattaccagcgcagtatcacgggtcatgcaccggtcacgtagcgtagataaaacccggaaccaaacttgacctacccccacaaacaagtcattattttattatatttatccttaaaaccctatttctcatttcatttcttctacaaccgtctactctagctcgttagttccgctatcactctactcttctactacttcacttcatcctctttgtttttcagcctagggtggtggtaattattcataactgtttcattatttttccttaatttctcattaattttccgttaatttttcaattagtgtaagctgatctgatttttttcctttgtttttgtttcgaattttgatggatcagccaagatcaagatcgtaatcaacggtaaatattatagttccttcgatctctgttcatttatgcgtcgatcggatttatattttttaatttagtttattttttgttaattttgtttgtaactgataggatttggaagaatcggaaaccggatccaaaaatggcggatgaagggggaattgcgaagtggcgctacgatgtatttctgtgttttagaggggaagacacgcgccacaccttcacaggtaatctctatgctgctttgcggaaggcgagattgaggacattcttcgatgttgggttgaagggtggtgaccaaatctttgaagctattgttcaagcattggaagcatccaggatttcaatcgttgttctctccaaaagcttcgcgtcttcctcgtggtgccttgaagaacttgtcaagatccttgagttaagggcaacaaagaagcaactagttattccaatcttttaccacgtggatccctcccatgtaaggaaacagactggtagtttcggagagtacctgattagacatgaaagtcgcttgggaaaggactccgagaaaatacacaagtggaagtcagctttgtatgaagttgccaccttggccggatggtgtttcggagacggaagctgcaggtatggcgttttttcttcttcttaatttagctagtaccgcttcttaattttaaaaaaagaaaatgaaaataataattttttgtaggcattcaatactgccttacactttgagagaaaaaagaaacacagaacaacgtgacattaataagagagataatgaaaaatataggtgtaaatatgtttttaatagtttagtgttttttttttaatttttgtaatttttgttatttttagtctttataaattatatatatatatattttacttttagttttaaaattactttaaatagtactctagatagtaaaaaaaaaagtcctataagaaccaaaataaaaataaacattgtttgtaaggattaaaacaaaaaataattttataaaaacaaaaaaataaatattaaattataagaattaaaaagatatttaagttaaaaataaaatgtttcgatccaatgaatttttagcctaggatggtgtttatgtatcattgttgaaattaaaatttcatatactaagttaagtaactcatgccgattattattgctgaagtcatgtaaacttgcattttaatcctcaaagaccaaaaccacttgtgatatttgcacgaagcttttttccttgatttataccttattgaatattctaacttctgagttgtcaaatgactcgttaacatgggcttgagccagtttatgtctagaattgcaaggctttggccaatattcttaaagtgacaatctaacgtaactagttaattctcctttcattcttaaaagaaaaacaaaatagaaaccaacaataattatactctttgataaggaatttgttttatgaattatcacactagaatttattattggtaagaaacaatctaagcttttagctaatttatcaagttaattttactttgttttgacttacgagttttaaggtttgaaatctttggggagattaattattcaaactcaattttattatattaaaaaaaattcttttaagcactctttattaaaattataaaatttatagatctcactttttacttaataattttcattcataatttttaattaattgtaagaaatgtgcaagtgtgtgagagagtttcttgcttgaacccgtcttaaagtaatcaataatagataaagaaaaacgtaaccagtgcatgaatgaattaaaaggtcatgtacttttttgtaggtaccaatatgaatatgaattcatcgaaaacattgtgcgagaagccatcgccattgtaccccgctatagcatttttctgagttttagtggaaacgatacccgctcctttacaggttttctgaacaatgcattgtgccggagtaggtaccaaaccttcatgaatgatggggaccaaatttcacaatctactaatggagttattgaagaatcaaggctttcgatcattgtattttctgaaaactatgcacgttcctcgtcctgtcttgatgtgcttttgaccatccttcagtgtatggagacgaaaaaccaactgatttgtcccatcttttacaaagtgttaccgtcggatttaaggcatcaaagaaatagctatggtgaagccatgactgagcatgaaaatatgttgggtaaggactctgagagggtgaagaaatggaggtcagctttgtttgatgtcgccaacttgaaaggattttacttgaaaaccgggtacaacacatattattcttttactttttgcttattttcatgattcatgtctattatactagtaatagttgatgataataatcacttaatatgtgcatcgttcttgaaattctatgaaccgtttaatttgaaatccgttcatttaaatttgactttgttaacaaggaataacgttgtgagagacattggggtacggagttaaggctttgtttagagtttgcaattctgtttttgttgttgtgtggtaattacttttgtgcggatttactttgataattttagaaagaaaatgaaaattgtgtatgaatgaactaaaaggccttgtatttttgtaggtacgaatatgaatttattgacaaaatcgtggaaatggccagtaaaatttaattagagctcgctgtttcattactgtggtagtgctataaattggcctactttttgtttcttacagtctattagcctagcagccgttaggcctcttttttaaatgtaataagttgaattcctgaactcgtgaagcttgccccttattgaaccgtagtgtttttggttgcttaataccattaagcaatgagttgttttggatttatatgcatttaccgaattttatttggatgatagtaagcgttttttccatgttcacaaatatgccatgaaaaaagcagtaaaatttcaataaaccaacatcatgataaaacaaaagtatgcatcgtatgaaaaaaagtgggtgatgaaatgataagtctaattttggtcgaatttggtcgttgttatttttgcatgaacatctcttttgtacaacctaacaacttatttgctatttttaatatttttgtactgcttttgatttgcttgctcttcacaatattatagtgttgcattagttgttcaattttggttgtacaaataatacaacttttaagcagttatcgtgaatgttagaaaaatcatgtgacttatctctgttattgggtgattgcatttgtttcgtgacttgtctttaatcggttacttattttcaataataaataacaatatagcattattttgtgtcactttcttacttttgattattgaaaagccgtgctcctttgcctgtctcttgagccatgtgattcgtcgtgaattgtgaggacgagatcatatttgagaaagaaaatgtgagctagacgtttctatagctttattacgtagcccttgcaattcaattcagcagggaacatatcaaaatgatttgtattgaaaaaattgttctacctacaaaaatctactttattatttgtactgaacgagaaagtgccacaatacttaattagataagtagacattggagctaatctcaaaattcttgcctgctttttctatcatatatctccatatcactaatgaattcattcggaccgctaattagctaagagacacttgtgtgattgagagaaacactaatcttgtgaggactgaagtttggtgattatttcttgtgatctgtcgacaaaaatatcaaatggggtttcttttacaaattatttacctaaatgaatctgttttgaaaatatttactccattgggtctatttttttattacaaagcgtctccctgaagggcgcgttccccgtgaaagtgacacgtggcaggacttgggacgtgccctgcgtacaggcgcgatagttagtgttgttacagcaggcgcatcgggtcgtgttggggaccaaggtacgacaggtcgcgctgggtgacccagacacgacccaattgggtcgcactttatttaatattttttatattttgtatattgtttttatttaatatatttttatattattttatttaatttttttatattttatataatagtttctatattaaataaattcttagcattatgtatgattttaaagtcataaataattttttatattgtttttatttactatattttttatattttatttaatatttatatattaaataaatccttcatattagaaaaaataaagaaaatattaaataaaatataaaatataaaaaagtaaaaaatattaaataaaataatataaaaaatattataaaaacaatataaaaaatataaaaatatttaataaaataataaaaaaaatattattttaaataaaattatttatgactttaaactctaaagttgaattttaaaaaaatataatttttttacgattttagtaaaaaaaaaatacaagccgcacaatacaagtcgccttctcaaacccttcctcacgacattctcggaccttatgacaccgtcaccaaaacaatgatccacgcgatattaggcgcgtgcaaatcactctaatccgaaactagtagacatgggaagcacgagctatacgcgagcgtttcaattgccgccacgaaagcagagaaggccagaaacggaaccacggtaaaatggtaagggtattttcgtaaacagaagaaaagagttgtagctataaataaaccctctaacccacggcgcactatttctcttcactccttcgttcactcttcttctcttgcggctagggttttagcgcagcttcttctaggttcgttctcttccgccgctctatggattttaaaccttcgaatcatgtttattccattgaattatgttgcttgcagtttatattttctgaatctgtagttgttgtcttcaatttatcctatgctttatagatcaatcttttgtgtgtgtagtacgtaatttttgttctttttgcttttcgttcaagttgttgggaataatcggggtatcatgttttgatattgtttgttttcttttttgactgcttaataatttttaagttggttttggttttggggttttatgtgcttgttatattcaaatctttgtgatccagatcttacaaaagttttgggtttaaggatgtttttggctgatgatgaatagatctataaactgttccttttaatcgattcaagcttaggattttactaggcttttgcgaataaatacgtgacagtaagctaattatgtcctttttttgtctcaatcatatctgtctgggtgtgccataatttgtgatatgtctatctggtagaatcttgtgttttatgctttacgatttggtatacctgtttttgaacttgttgtatgatgggtatttagatcaccctatcttttttatgcttctggaagttttatgtaaatgtcgaatatcttaatgttgttgaacttataatgttgtgttgatgtatgtatgatggttttgacaacttttttcactggttctgaaagttttatgtaaattgcaaatatgttaatgttgttgaacttattttttttccttcgatgttgttttgatgtatgtatgatggttttcaccgtagtttctatggctaatatcttaatgttgttgagcttatttttttccttatatgttgtgttgatgtattgtatgatggttttgacaacttttttagtttctttgcagatttaaggaagaaaaaaaaaatggctcttgttgctagaccagtgctttctgctagagttgctgcttctagaccaagagttgctgcaagaaaggctgttagagtgtctgctatgtctcatggtgcttcatctagaccagctactgctagaaagtcctctggactttctggaactgttaggattccaggcgataagtctatttcccaccgttctttcatgttcggaggacttgcttctggtgagactagaattactggacttcttgagggcgaggatgttattaacactggaaaggctatgcaggctatgggagctagaattagaaaagagggcgatacctggattattgatggtgttggaaacggtggacttcttgctccagaagctccacttgatttcggaaacgctgctactggatgcagacttactatgggacttgttggagtgtacgatttcgattccaccttcattggagatgcttctcttactaagaggccaatgggaagagtgcttaacccacttagagagatgggagttcaggttaagtctgaggatggtgataggcttccagttactcttagaggaccaaagactccaaccccaattacttacagagtgccaatggcttctgctcaagttaagtctgctgttcttcttgctggacttaacactccaggtattaccactgtgatcgagccaattatgaccagagatcataccgagaagatgcttcaaggattcggagctaaccttaccgttgaaactgatgctgatggtgttaggaccattagacttgagggaagaggaaagcttaccggacaagttattgatgttccaggtgatccatcttctaccgctttccctcttgttgctgctcttttggttccaggatctgatgtgaccattcttaacgtgctcatgaacccatctaggaccggacttattcttacccttcaagaaatgggcgctgatattgaggttatcaacccaagacttgctggtggtgaagatgttgctgatcttagggttaggtcctctactcttaagggtgttactgttccagaagatagggctccatccatgattgatgagtacccaattcttgctgtggctgctgctttcgctgaaggtgctactgttatgaacggacttgaggaacttagggtgaaagagtctgataggctttctgctgttgctaacggacttaagcttaacggtgtggattgtgatgagggtgagacttctcttgttgttagaggtagaccagatggaaagggacttggaaacgcttctggtgcagcagttgcaactcatcttgatcataggatcgctatgtccttccttgttatgggtcttgtttctgagaacccagttaccgttgatgatgctactatgattgctaccagcttcccagagttcatggatcttatggctggacttggagctaagattgagctttctgataccaaggctgcctgactaattagctaagagcttgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 18 - DNA, 20350 bp, Artificial
  Vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggaccccaggatagctgacacacaaagtggcaaagaaatgctgctcgatccaggtattccatacttttcaactgcaaactgaagctgaaggtgaaattgttgcttgtacatgtgtatacgtgtcatttctttccttgttttcatagttttgtgaaaataataaaaaatgttttaaaatgttaaattatagctacacacttgtttaccaattagaaaacccttttgtattttctgcaatcatcattgaatttgagaacctggctagatctcattctcatcagatcactatataccattttggtcttcagagcattgaagtagctaacttacatgtatgttcttacttcataagcatgggctatttgtacattttgccacatcatctttatgtcttgatgcagaacaaaaagctgaatactatagaaggatgcgagatgatttgaagaaggctgacaaggaagacaagcttatagagcgtcagcggcttagagaaaaaagaatcaagcagaagttgaaatggaaggctgggaatgcggaagaggacgaccaagatgatatatctgggtcagaagtagatgagactgttgatagacggcataaaaagagtaaaatatactttgatagtgacagtgacgagggtgaaagaaatgaagtttcagggaatgctggtataactaccggtgcggttacgttggaggagcaagaagctctggctttgaaattgttaaattccatgcactcataggatatgcgtaattcagctggacattttgtgacagcaaaaactagtgaaaagagagcaattcctgaaacattttaggagttctgttaacaaaaaattttgatctcccaatttttttctgtcatctctttcaagaaacgtatacataagaatcaatttactgcttttatttattttaactaaaaaaaatgggactaaaggacatccttgtgtgtaccaaacacgatattaaatattattaggagatattcataatagttgtacttcaaaatctgaatcgtttacaggaaaaaaactagcaccaaaatggtgtctttgccccctgttagttagagaccccaatgaagtctatagaaatgtcagatcaaatgttttgtggaaatgggccgagtttatggtctcgtacagtcgtacttattccgttgcattgtataggcgtggaagaaacttgagtgttctcccgttgcttagactgcgtttttggaattaagacaacgataaaaggatatggacagaatttcaattatttatgagaaacaagaactatcaacgggagcttttttggtttgaaaaaaaaaacttttggatttctgtttattacaactattataaataagaacttaattattacaactattaaattaaattaagggtttagattaaatacttaattacaaatcttgtcattgataattttttttacaaattttgtgtattttttttttaaatggagattatagtaatgacatgactggtttgttgataagaaaatggagaagaaaacaaaaactccatccatccatctggtccagtcaacccatgttcatgtattttatttcagcttgacattgaagtggggcgcagcaaggaaattaagcaaaaccgcgtagggcatcgtgttaatattttaaatttatgaaagagagaaagagaagtagggaggcattggccattaggaggagtcaacgagacaagcaagccaccttctgctacttctcatccatcatgtcgaatgaactcaaaaactacgatgtttttctcagttttcatggcgaagattcccgttacaccttcactggtactctctataatgctttgcgcagcaagagaatcaagacctttttcacagaacatgaatatgatcgtaaactacacactcatgacagccaaattccacactctactcttgaagcaatcaaggaatcagggatttcgatggttgttttctcggaaaactatgcatcctcctcaagatgtcttgatgaacttgtggccatccttgagtgtaacaggacgataaaccaactggtgtggcccatcttttacggagtgtatccgtggcaagtaaggcaccagggcggtaactatggagcatctatgtctaaattagaagaaatatttagagattccaatgagagggtgaagcaatggagagcagctttatttgaagtcaccaacttgaatggatggtgttaccaaactgggtatgcttaattttagttgattaagttccattattaatctctacaactgctagcatagcatggcaccacttctttattacttattgtatctgtaatctgctgaacagtatgtctgatcttctaattatcgttttagaaagtcactttgttttgtttaaccgagagaaatacatgtgtgctgtaaattaaaggttctgtttccagtttcagtgtagcagtagcaatctgttctgtgcatacatatagattagtcaagcttaagtcaactaattctgattaatagaaacaatatggttgtccatgctcgaatacccctggtgaattaaaaagacttgtgcttttataggaggtaccagtatgaatatgaattcatcgaaaggatcgtggaatcagccgtgcaagccttgcccggatatgatgtttttctgagttttaccggagaggatacccgctacactttcacaggttttctctataatgcctttcgccgagagggattcaaagtcttcatggacgatgaggaattggagagtgggaaccaaatatcacagaagcttatgggagcaattgaaagttcaaggatttcaattgttgtgctttctgaaaactatgcatattccacgtggtgtcttgatgaacttgccaagatcattgagcgtacgaagaccaacaatcaaatggtttggccaatattttacaatgtgcaaaagtcggatgtatgcaatcaaacaaaaagttatggtgaagccatgactgaacatgaaaaaagatttggaaaggactctgagaaggtgcagaaatggagttctgctttgtctgaaatcaacaatttggaaggagaccatgtcaaagaaaatgagtacgtaatgcttttaattagttacttaatatatgcttccctcttaagtgatattgaccatctatgaaatgctaaacatggcatagttcttgtccgagacatggggtattgtgtgttgttttgtttggagcagtttttgtattttgtacggcaatctgttagtgagaagattaattagtcgagcttaatattgttgttttaatgacataaagtctgattaggagaaataaagtgaacacagcggatgaattcttaaaagaccttgcacttttgtaggtaccaacatgaatttatcgaaaggattgtacaaaaggtcattaaacttgaaggtagcaagcatatagcaaatcatttccttttatccaatgacagctacgagaaagaatgagtgaaagtcggtcaagtatatgctgtggagctgtgtgactaactgattgtaacatcaataactgcccttgaattcagttgtgcctatcaatgttgtttttacatccagttcaattcctaaggttttttgtatttcttctaaatcttgttcaattctcgaggtctgttgtgttttttctacatcttgtttcaatgttttgtgttgattagataaaaaaaacaagtggtactattttgttttgtcatattggcattaggtaaggcaccgtgaaacaaaatttaaacacatcgccttctactcacaaaaataaaaacagagtatacacaatctatggtaaggttaaataagttttcatcattcatctatttcagaattccatttttaattctctcaattttctttatccaaagttagtctctattttttaagtaagtttagtctcccacattaaataaaaactatcaaatacttatatgtccaacaaaattacatgtcacaacacacatgatgtaatcatgtgacacccatgtgggtgatactaacatgtttagtcacatggtatcatgtgtctttagaaatttttgaaatttaaattttagttcctaaaaaattatcatctttcaattttagtcaataaaaatttgttttatttaatttaagtcctttaaaaaaaattaaattttagtttttaatccttaattaattttttaaatcttagtatagttatgctttagtgatttgttggtcatgagtttgaatatgtaaaaagtttatttgcatatacaagagtaaggttgtgtacaatatctctttccttatctttgtataacaaggagcctatgaacaatgtgatacataattttttttttctagtttaggtatttctagaatatttaatctcttcattattcaccttggtatcacaaatatcatcacaagtatgttcaaaccatttggttaagtcctacattttgtcccaattttggattggatttttcttcctacactagctagtgttcccatacacccagcaataaaatgaaaaactgaaaatacccttccgtaaggttcatacatattggccaatccgtatcctttgttgtcgtcaagctcagtgccctcccagcctttggccaactcaccgacatcgtcggaccccacctctaaccgcatggaagagaaggcccactccctcggcatccccctctctatcctcgaccacaatccccacctcaatctcgccatcgacagcatcgacgaggtcggtgaggcgatatgtaattcataagattttacgaatttgcaatccataagattcttacggatttttcaatttgtatgaaccttacggattgccaatccgtatgaatcttatggaagaatattttttatttttcgttgtctttggtgggtgtatgaagaaatttgtctagtgcatgaagaaaaatgcttgtggatttctgttattggaggttcattttgagctatgactcttgcactttatttttattttgaatagaatatacaattaataatttctatatattcaaagtaattggatccacatttagacaataatcttttttttctctctatttggcaaaaatattgtgtaagtttgtaattaattagaatttaggttgaaactaattattttatttcatgtggttagttattattatatattttaatgatttcatcgtattattaattgcttgtgatacaaagttaattaatagttgtgatgtaaagttaattatatttttgcatgcaattaactatatctaatagtaaataatttttagtcacagtaaaatcaactatatttatacatacaatataatttctgcattctgttataattgtatttttaggttgttatatataaatagttgaaaaagaatgataattttatatcatcattaatttatttataaattttattgtctattattaatctcataagagatataaataaaaaaagataattaatattaccttaaaataataataaaataattattttgagatttttttcttgtgacaattataatgagattaaggaaataatattttttttcaagtggtgatgaaatgcacaaatttgagtgggacaactataattttcgaatagaaaatggagaagaaaacaaggactccatccatgtattttatttccaggaagcagcaaggaaattaagcaaaagcgcgtaaatgatagtgtcagcacatcatataatatcttatgttatctgcttaatagtttcattgcgatggcggatgaagggggaattgcgaagtggcgctacgatgtatttctgtgttttagaggggaagacacgcgccacaccttcactggtaatctctatgctgctttgcggaaggcgagattgaggaccttcttcgatggtgggttgaagggtggcgacctaatcgcagcagctattcttgaagcattagaaggatccaggatttcaatcgttgttctctccgaaaacttcgcgtcttcctcgtggtgccttaaagaacttgtcaagatccttgagttaagggcaacaaagaaccaactagttattccaatcttttaccacgtggacccctcccatgtaaggaaacagactggtggtttcggagagtgcctgattaaacatgaaagtcgcttgggaaaggactccgagaaaatacacaagtggaagtcagctttgtatgaagttgccaacttgtccggatggtgtttcagaagcaggtatggcgttttttcttcttcttaatttagctagtaccgcttcttaattttaaaaaaagaaaatgaaaataataattttttgtaggcattcaatactgccttacactttgagagaaaaaagaaacacagaacaacgtgacattaataagagagataatgaaaaatataggtgtaaatatgtttttaatagtttagtgttttttttttaatttttgtaatttttgttatttttagtctttataaattatatatatatatatatattttacttttagttttaaaattactttaaatagtactctagatagtaaaaaaaaaagtcctataagaaccaaaataaaaataaacattgtttgtaaggattaaaacaaaaaataattttataaaaacaaaaaaataaatattaaattataagaattaaaaagatatttaagttaaaaataaaatgtttcgatcaaatgaatttttagcctaggatggtgtttatgtatcattgttgaaattaaaatttcatatactaagttaagtaactcatgccgattattattgctgaagtcatgtaaacttgcattttaatcctcagagaccaaaaccacttgtgatatttgcacgaagcttttttccttgatttataccttattgaatgttctaacttctgagttgtcaaatgactcgttaacatgggcttgagccagtttatgtctagaattgcaaggctttggccaatattcttaaagtgacaatctaacgtaactagttaattctcctttcattcttaaaagaaaaacaaaatagaaaccaacaataattatactctttgataaggaatttgttttatgaattatcacactagaatttattattggtaagaaacaatctaagcttttagctaatttatcaagttaattttactttgttttgacttacgagttttaaggtttgaaatctttggggaaattaattattcaaactcaattttattatattaaaaaaaattcttttaagcactctttattaaaattataaaatttatagatctcactttttacttaataattttcattcataatttttaattaattgtaagaaatgtgcaagtgtgtgagagagtttcttgcttgaacccgtcttaaagtaatcaataatagataaagaaaaacgtaaccagtgcatgaatgaattaaaaggtcatgtacttttttgtaggtaccaatatgaatatgaattcatcgaaaacattgtgcgagaagccatcgccattgtaccccgctatagcatttttctgagttttagtggaaacgatacccgctcctttacaggttttctgaacaatgcattgtgccggagtaggtaccaaaccttcatgaatgatggggaccaaatttcacaatctactaatggagttattgaagaattaaggctttcgatcattgtattttctgaaaaatatgcacgttcctcgtcctgtcttgatgtgcttttgaccatccttcagtgtatggagacgaaaaaccaactgatttgtcccatcttttacaaagtgttaccgtcggatttaaggcatcaaagaaatagctatggtgaagccatgactgagcatgaaaatatgttgggtaaggactctgagagggtgaagaaatggaggtcagctttgtttgatgtcgccaacttgaaaggattttacttgaaaaccgggtacaacacatattattcttttactttttgcttattttcatgattcatgtctattatactagtaatagttgatcataataatcacttaatatgtgcatcgttcatgaaattctatgaaccgtttaatttgaaatccgttcatttaaatttgactttgttaacaaggaataacgttgtgagagacattggggtacggagttaaggctttgtttagagtttgcaattctgtttttgttgttgtgtggtaattacttttgtgctgatttactttgataattttagaaagaaaatgaaaattgtgtatgaatgaactaaaaggccttgtatttttgtaggtacgaatatgaatttattgacaaaatcgtggaaatggccagtaaaatttaaaatggcttaaatcgatcaagccctcgctcaagtgtcaactagaaggcagaactgatcaattcaacagattacagatggttctatgagcagtcattagctcacaaattgatagtaatagtcgtaatgcttacaatcagcactgaggaattgatttggaagtctgaattttacttagaacattagcaatttctagaaaggtgaatatatatgtcctgagggccatggccagaggcctgtcatcttgaaattgtgacacacactctcgtttaagtcatatttactttgatttcccaaatgtcatgcatatacaaataattgtatgagttagattaaagaagctttagcattaaacagattgaagacaattacccagttaagatgctgaatgatgtttttgttgagaatcaaccgacatagttattcatgatgtatataatcgaatttcgtaagacacaccaaacatatccttgcatgataacttttgattttggggtgtatcccgccgggaagatattcaagattgtgcagtgtcacaaatacccttaaaaaatgattaacgcattatgattttagttagttaatagtaaaacgattgctgcaagtttaaaaagatttgaaatagtttatagtattttgaccgtgaaattttgtgcttgttttagtcgacacaatcccatagatatttgagaaaaaggataaacattttctctgaaagtcttgtatcttcctcaataggtactgtaccataggttaatgttaaatttttaacatgagaacaaactaaaagtatgtaataaagagtaaagtgcaaattgatcacagaacaactttaaaataaaagagtattgacgaaaataaagtgggcaaaaaaaaaaagatacagaaaattaaaggagtaaaaagtttggagaagaaattgagattgaaaaaagatgaagatttaaagggaagtataacaaatgtaaaagaaagcgataaaatgaataagataaagtgctgaaattaaaatgtttgagagtattgtaataattcattgatccacaagtgtcacgatgagacaagaggatatgtgagtgtttacaagtttcaactcttattacaaatttttaaatctttctcatcgataactttaatattcaatgtcaatcattgatgtcttttgtctttggtattcgtttttaatatattcttcaagaggtatttgtagatttttgttcctctaatggttaaactcaaatgctttatgaaattattgcttaaaaacatgttattttccccgtgtcaggtgacctctaaaaaagatcaagctcaatactgggctgattcttcaaagccatataaatttatttcactgccggagattgcataagcctttaaaaattccagatttggaaagtcggtagaatccatgtgtactgctccctttgataaattaaagagtcatccttcagctttccccagaactagatttgctgtgccaaaatgggagctctttaaggcgtgtttctcgcacgagaccttgatcaacaggcataagttcggacccctaattagctaagagacacttgtgtgattgagagaaacactaatcttgtgaggactgaagtttggtgattatttcttgtgatctgtcgacaaaaatatcaaatggggtttcttttacaaattatttacctaaatgaatctgttttgaaaatatttactccattgggtctatttttttattacaaagcgtctccctgaagggcgcgttccccgtgaaagtgacacgtggcaggacttgggacgtgccctgcgtacaggcgcgatagttagtgttgttacagcaggcgcatcgggtcgtgttggggaccaaggtacgacaggtcgcgctgggtgacccagacacgacccaattgggtcgcactttatttaatattttttatattttgtatattgtttttatttaatatatttttatattattttatttaatttttttatattttatataatagtttctatattaaataaattcttagcattatgtatgattttaaagtcataaataattttttatattgtttttatttactatattttttatattttatttaatatttatatattaaataaatccttcatattagaaaaaataaagaaaatattaaataaaatataaaatataaaaaagtaaaaaatattaaataaaataatataaaaaatattataaaaacaatataaaaaatataaaaatatttaataaaataataaaaaaaatattattttaaataaaattatttatgactttaaactctaaagttgaattttaaaaaaatataatttttttacgattttagtaaaaaaaaaatacaagccgcacaatacaagtcgccttctcaaacccttcctcacgacattctcggaccttatgacaccgtcaccaaaacaatgatccacgcgatattaggcgcgtgcaaatcactctaatccgaaactagtagacatgggaagcacgagctatacgcgagcgtttcaattgccgccacgaaagcagagaaggccagaaacggaaccacggtaaaatggtaagggtattttcgtaaacagaagaaaagagttgtagctataaataaaccctctaacccacggcgcactatttctcttcactccttcgttcactcttcttctcttgcggctagggttttagcgcagcttcttctaggttcgttctcttccgccgctctatggattttaaaccttcgaatcatgtttattccattgaattatgttgcttgcagtttatattttctgaatctgtagttgttgtcttcaatttatcctatgctttatagatcaatcttttgtgtgtgtagtacgtaatttttgttctttttgcttttcgttcaagttgttgggaataatcggggtatcatgttttgatattgtttgttttcttttttgactgcttaataatttttaagttggttttggttttggggttttatgtgcttgttatattcaaatctttgtgatccagatcttacaaaagttttgggtttaaggatgtttttggctgatgatgaatagatctataaactgttccttttaatcgattcaagcttaggattttactaggcttttgcgaataaatacgtgacagtaagctaattatgtcctttttttgtctcaatcatatctgtctgggtgtgccataatttgtgatatgtctatctggtagaatcttgtgttttatgctttacgatttggtatacctgtttttgaacttgttgtatgatgggtatttagatcaccctatcttttttatgcttctggaagttttatgtaaatgtcgaatatcttaatgttgttgaacttataatgttgtgttgatgtatgtatgatggttttgacaacttttttcactggttctgaaagttttatgtaaattgcaaatatgttaatgttgttgaacttattttttttccttcgatgttgttttgatgtatgtatgatggttttcaccgtagtttctatggctaatatcttaatgttgttgagcttatttttttccttatatgttgtgttgatgtattgtatgatggttttgacaacttttttagtttctttgcagatttaaggaaggatcctaaaccatggctgctgctgctgcagctccatctccatcattctctaagaccttgtcctcttcatcctctaagtcctctactcttttgccaaggtctactttcccattcccacatcatccacataagactactccaccaccacttcatcttaccccaacccatattcactctcagagaagaaggttcaccatctctaacgttatctccaccacccaaaaggtttcagagactcaaaaggctgagactttcgtttctaggttcgctccagatgagccaagaaagggatctgatgttcttgttgaggctcttgaaagggaaggtgttactgatgttttcgcttatccaggtggcgcttctatggaaattcatcaagctcttaccaggtcctccatcattagaaacgttttgccaagacatgagcagggtggtgttttcgctgctgaaggatatgctagagctactggattccctggtgtgtgtattgctacttctggaccaggtgctaccaaccttgtttctggacttgctgatgctctccttgattctgttccaattgtggctattaccggacaagttgctagaaggatgattggaaccgatgctttccaagagactccaattgtggaagtgaccagatctatcaccaagcacaactaccttgtgatggatgttgaggatattccaagggttgtgagagaggcattcttcttggctagatctggtagaccaggaccagttcttattgatgtgccaaaggatattcagcagcagcttgttatcccagattgggatcaacctatgagacttccaggttacatgtctaggcttccaaagcttcctaacgagatgcttcttgagcagattgtgaggcttatttccgagtctaagaagccagttctctacgttggtggtggatgctctcaatcttctgaggaacttagacgtttcgttgagcttaccggaattccagttgcttctactcttatgggacttggagctttcccaactggtgatgaactttctctttccatgcttggaatgcatggaaccgtttatgctaactacgctgtggattcctccgatcttcttcttgctttcggtgttaggttcgatgatagagttaccggaaagcttgaggctttcgcttctagagctaagattgtgcacatcgatatcgattccgctgagattggaaagaacaagcagccacatgtgtccatttgcgctgatattaagcttgcacttcagggactcaactccattcttgaatccaaagagggaaagctcaagcttgatttctctgcttggaggcaagagcttactgttcagaaggttaagtaccccctcaacttcaagactttcggagatgctattccaccacagtacgctattcaagtgcttgatgagcttaccaacggctctgctattatttctactggtgttggacagcatcagatgtgggctgctcaatattacaagtacagaaagccaaggcagtggcttacttctggtggacttggtgctatgggattcggacttccagctgctattggagctgctgttggtagaccagatgaagttgttgtggatatcgatggtgatggctccttcattatgaacgttcaagagcttgccaccatcaaggttgaaaaccttccagtgaagatcatgctccttaacaaccagcatcttggaatggttgtgcaacttgaggacagattctacaaggctaacagggctcatacctatcttggaaacccatctaacgaggctgagattttcccaaacatgcttaagttcgctgaggcttgcggagttcctgctgctagagttactcatagagatgatctcagggctgctattcagaagatgcttgatactccaggaccataccttctcgatgttattgtgccacatcaagagcatgtgctcccaatgattccatctggtggtgctttcaaggatgttattactgagggtgatggaaggtcctcctactaagagctcgcattttgtacattgagtagggaagagagagagatatatataaatactcacaaagcagtgagtatatggcttgcttttgtttctaaacattcctttataaggacttgagataatttgtattgtttaaaagagccattggttctgttgtatcaaagtaatttaattttcagtaccgacttggctctactcatatgtggtggtgtacattgcatctttgcatttgattccatatctattgggatgggaccatacattttttgtttattatttaagtcaaacatatcagataatatgtggtgaccagaaaagtgtctagcaatcaaatgggtctgtgattgcatgtttgagttcaggacatttattaatgagtgacagaattttaaaaagctcgccaataggagttgccacatctgatcgagtcttctgtaaacactaactgtaacttgagtttgataatcagattccccccgttggtaggtaatatgtaaatttcactatagattcttactgaggatgatggtcttgacttcgaagtggtgagtgtaattctctaatctaaactttatatatatataaaaaaagaatgttaaaaacttgagtgacatacagcaaatagcaatgaaagcatgaccattggccttggggggccaaatggccatgtaccacttttccacctacttgagagccattggtcctgaatgaggtccttttgtttcattttttttacaataaagaaagttcatattcttggcaatagcaaggcaaatcatttgtggaagtcacatgaaattcaccatactaattagctaacggacccgatttaaatcggtaccactagtaatattcggaccgcctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 19 - DNA, 1160 bp, Arabidopsis thaliana
aagcttgatatcggaagtttctctcttgagggaggttgctcgtggaatgggacacatatggttgttataataaaccatttccattgtcatgagattttgaggttaatatatactttacttgttcattattttatttggtgtttgaataaatgatataaatggctcttgataatctgcattcattgagatatcaaatatttactctagagaagagtgtcatatagattgatggtccacaatcaatgaaatttttgggagacgaacatgtataaccatttgcttgaataaccttaattaaaaggtgtgattaaatgatgtttgtaacatgtagtactaaacattcataaaacacaaccaacccaagaggtattgagtattcacggctaaacaggggcataatggtaatttaaagaatgatattattttatgttaaaccctaacattggtttcggattcaacgctataaataaaaccactctcgttgctgattccatttatcgttcttattgaccctagccgctacacacttttctgcgatatctctgaggtaagcgttaacgtacccttagatcgttctttttctttttcgtctgctgatcgttgctcatattatttcgatgattgttggattcgatgctctttgttgattgatcgttctgaaaattctgatctgttgtttagattttatcgattgttaatatcaacgtttcactgcttctaaacgataatttattcatgaaactattttcccattctgatcgatcttgttttgagattttaatttgttcgattgattgttggttggtggatctatatacgagtgaacttgttgatttgcgtatttaagatgtatgtcgatttgaattgtgattgggtaattctggagtagcataacaaatccagtgttccctttttctaagggtaattctcggattgtttgctttatatctcttgaaattgccgatttgattgaatttagctcgcttagctcagatgatagagcaccacaatttttgtggtagaaatcggtttgactccgatagcggctttttactatgattgttttgtgttaaagatgattttcataatggttatatatctctactgtttttattgattcaatatttgattgttcttttttttgcagatttgttgaccag

SEQ ID NO: 20 - DNA, 1717 bp, Artificial
  Modified version of Arabidopsis Ubiquitin 3 promoter
ggagccaagtctcaaaaacgccaatgtggaagaaagtcttgagttggtggtaatgtaacagagtagtaagaacagagaagagagagagtgtgagttacatgaattgtcgggcaacaaaaatcctgaacatcttattttagcaaagagaaagagttccgagtctgtagcagaagagtgaggagaaatttaagctcttggacttgtgaattgttccgcctcttgaatacttcttcaatcctcaaatattcttcttctatgttacctgaaaaccggcatttaatctcgcgggtttattccggttcaacattttttttgttttgagttattatctgggcttaataacgcaggcctgaaataaattcaaggcccaactgtttttttttttaagaagttgctgttaaaaaaaaaaaaagggaattaacaacaacaacaaaaaaagataaagaaaataataacaattactttaattgtagactaaaaaaacatagattttatcatgaaaaaaagagaaaagaaataaaaacttggatcaaaaaaaaaacatacagatcttctaattattaacttttcttaaaaattaggtcctttttcccaacaattaggtttagagttttggaattaaaccaaaaagattgttctaaaaaatactcaaatttggtagataagtttccttattttaattagtcaatggtagatacttttttttcttttctttattagagtagattagaatcttttatgccaagtattgataaattaaatcaagaagataaactatcataatcaacatgaaattaaaagaaaaatctcatatatagtattagtattctctatatatattatgattgcttattcttaatgggttgggttaaccaagacatagtcttaatggaaagaatcttttttgaactttttccttattgattaaattcttctatagaaaagaaagaaattatttgaggaaaagtatatacaaaaagaaaaatagaaaaatgtcagtgaagcagatgtaatggatgacctaatccaaccaccaccataggatgtttctacttgagtcggtcttttaaaaacgcacggtggaaaatatgacacgtatcatatgattccttcctttagtttcgtgataataatcctcaactgatatcttcctttttttgttttggctaaagatattttattctcattaatagaaaagacggttttgggcttttggtttgcgatataaagaagaccttcgtgtggaagataataattcaacctttcgtctttttctgactcttcaatctctcccaaagcctaaagcgatctctgcaaatctctcgcgactctctctttcaaggtatattttctgattctttttgtttttgattcgtatctgatctccaatttttgttatgtggattattgaatcttttgtataaattgcttttgacaatattgttcgtttcgtcaatccagcttctaaattttgtcctgattactaagatatcgattcgtagtgtttacatctgtgtaatttcttgcttgattgtgaaattaggattttcaaggacgatctattcaatttttgtgttttctttgttcgattctctctgttttaggtttcttatgtttagatccgtttctctttggtgttgttttgatttctcttacggcttttgatttggtataagttcgctgattggtttctacttgttctattgttttatttcag

SEQ ID NO: 21 - DNA, 1949 bp, Glycine max
gtgattgcggttacatcatgtacggaaaaataattctaatccttgatttaaatttgatcttgactatttatttattctttatttcattttgtaaatcattttatgtatcccctggcaaggcaattttatccaccttgcacccaacacttcgggttcccataaatcaaaccaccttaacttcacacaatgctgtaactcacaccgcccagcatctccaatgtgaaagaagctaaaatttaataaacaatcatacgaagcagtgacaaaataccagatggtattaatgctttgataaaattaattggaaagtataaaatggtaggaaataattaattataattaatttaaataagattaaaaataatttaaaactaaaatgttaaaattttaagaaaattattttaaataatatttaaaaacatttaaaatcattttaaaaaatttatttataggacaattaaatgaatatttcagctaattaaaaacaaaagcttacctagccttagaagacaacttgtccaacaattagatgatacccattgcccttacgttttctttaacatcaattattgtttttgtcaacaagctatcttttagttttattttattggtaaaaaatattgtcgccttcaagttgcatcatttaacacatctcgtcattagaaaaataaaactcttccctaaacgattagtagaaaaaatcattcgataataaataagcaagcaaaattaggaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaaggggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaattgcccccacacccctcgaccctaatcgcacttgaattgcaatcaaattagttcattctctttgcgcagttccctacctccccctttcaaggtccgtagattcctcctgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacag

SEQ ID NO: 22 - DNA, 636 bp, Linum usitatissimum
ttttgtatcacacgcgttactcatcataaataaccaggagtccaggatctcataacaactgcagtattgacttgtacacactacagtcgaaaaaagttacaatttgaagtttcaacacatccggacgatgatcggataaaaggatgaacaactttctttgaactaccaactaagaattagaaagacacagcagtaagaatcaagatagatgaaggacacagaggaaacaagaaattgatcacagatggcttccttttacatctttacatagatataaacaaagatataattgattcaaagcgcacactgagattggattgggggattgtctgctatcttgatcctattcactctgtgacgcggctaccactcagacaacctcacagctggacaaatcgacaaactcttgaataataattggcctgtagattcagtggaaccatcactacctctaaagctgcacggctgacaccgcaacacaaataacttgccacattttctctctatcaaatcaaaatcgacgtctctttctcctcctcatcactgagtttgttcatacttgcccaaccaaatagcttggtacttttagccaatcagggtgccatagagatcatttccactccaatcaagccctta

SEQ ID NO: 23 - DNA, 27 bp, Artificial
  primer
accctctcattggaatctctaaatatt

SEQ ID NO: 24 - DNA, 23 bp, Artificial
  Primer
gagtgtatccgtggcaagtaagg

SEQ ID NO: 25 - DNA, 30 bp, Artificial
  probe
agacatagatgctccatagttaccgccctg

SEQ ID NO: 26 - DNA, 22 bp, Artificial
  Primer
cattggaagcatccaggatttc

SEQ ID NO: 27 - DNA, 26 bp, Artificial
  Primer
tgcactggttacgtttttctttatct

SEQ ID NO: 28 - DNA, 27 bp, Artificial
  Probe
atcgttgttctctccaaaagcttcgcg

SEQ ID NO: 29 - DNA, 25 bp, Artificial
  Primer
tgtgtgagagagtttcttgcttgaa

SEQ ID NO: 30 - DNA, 26 bp, Artificial
  Primer
tgcactggttacgtttttctttatct

SEQ ID NO: 31 - DNA, 19 bp, Artificial
  Probe
ccgtcttaaagtaatcaat

SEQ ID NO: 32 - DNA, 15498 bp, Artificial
  Vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggacccttaactaagttgccatcgtttcatcctagggttttattgttactgttattggcaattagatatctgaaatttggtggcatgcttcagagttagaggatggagttttcaagtttttttggtttttgtttgatgatgttctaagttttttggtttagcttttgctggtctattaatggcatgatgcttcactgatgacaaataacaatgtaatgaagtgtcagttttgattttaagccatattcgtgtattgttaaagcatccaattttgtcaatcaattgatgcttcaagtatttcttttattaatgcaatgaattttcgttttaccttataatccatatgagaactttctttaattttccagttatgtgtatattgattttgtattttgttgtaaagaattaatcatagtgcactgaacctagcaaaacttgggaatttgttgatattgaagctaatttaatcaatagtcttgcttaaatggaataagaatggcgtggtactcttcaaaatatcatgattgcacatttattttccctttaccgcttcacaacatttaattcagcactactatcaattattctctatcaatgcatattcccatgcaccagcaaaagtatgtcatgtaactataaatataggtgcggtgctatcgaaaggcttgccattctcattctaaactcacttagcatcacatgtttgtatcaaaaaatggctttacgtgagtttgagagcttacttgctttgatttgcttgaaaggtcccataatctttgtttattatgtttatggtttatttttatgtgaatatgaaaaccatccagcatcaaaatctaaacgaaggaccgcatattatttaccatcatttttaccaattttcattctcaacaacaccattatttacccaagaaaataattaaacaacaacatattattttccgccaaccgttgctttttctacggacacccaaatgtaaaacacccttaattccaaagatttccaagatataaataaatacaccataaacattcttcttctaacaaagaagacctaaccattgttctaacagtaacacctaaaattcagttacctaacatgtcaaagtgaaaactgagcacaaaaactaaaatcaaaacaccagttaagaaaataattaaacaacaacacaaaattttgcattttgatgtatgaaaagctttaaaaaaagtgactatttctaaaatcacttttaaaaaaagaaacatccaaagtcatgagtgagtcaaaggggttataaacttctgcattaccctaatctttctattcttgaaattccatgagaaaataaacaacagcacataaatgggttaagctttaaaaaaagggataatttgtaaaatcactttttcagacatttttgtttatgcatgtggtaaaagtcatctaaagaacatccaatggaagaatcgtacaaaaaatcattgatctaacagaatggaccaaaacgagattaaaaaaaaacttaaatactcaaacaatcctttttttagttaagaaattaaaacaataccaattaaatatttaaggaaccaaaataacatttaagcctaaattattttgactaacataaatacataattaaaaactattttaaaatttcaatacaacgacacaccttgagagactaaaatgattattattcatattatccattaaaaaggaaaaggagtgcgtgtgaaaagcaggccacacgtatatgggccttgaactcgaattcgaattcgaatcttgtggccacctaaccacttcactaaactcacgaataattggtgaacaattctttacaacgaaactaacgaatatcctaataccagatcctaatgacatttttacccctaaactcttaccctcaacactttcaaaagaatcatcactaaattgtcattttaacacactctagaacctactttgataacgaaaaagtagaaagaaacccgtgctaggtcccacccaatagacaacgcaaaccacaattaccagcgcagtatcacgggtcatgcaccggtcacgtagcgtagataaaacccggaaccaaacttgacctacccccacaaacaagtcattattttattatatttatccttaaaaccctatttctcatttcatttcttctacaaccgtctactctagctcgttagttccgctatcactctactcttctactacttcacttcatcctctttgtttttcagcctagggtggtggtaattattcataactgtttcattatttttccttaatttctcattaattttccgttaatttttcaattagtgtaagctgatctgatttttttcctttgtttttgtttcgaattttgatggatcagccaagatcaagatcgtaatcaacggtaaatattatagttccttcgatctctgttcatttatgcgtcgatcggatttatattttttaatttagtttattttttgttaattttgtttgtaactgataggatttggaagaatcggaaaccggatccaaaaatggcggatgaagggggaattgcgaagtggcgctacgatgtatttctgtgttttagaggggaagacacgcgccacaccttcacaggtaatctctatgctgctttgcggaaggcgagattgaggacattcttcgatgttgggttgaagggtggtgaccaaatctttgaagctattgttcaagcattggaagcatccaggatttcaatcgttgttctctccaaaagcttcgcgtcttcctcgtggtgccttgaagaacttgtcaagatccttgagttaagggcaacaaagaagcaactagttattccaatcttttaccacgtggatccctcccatgtaaggaaacagactggtagtttcggagagtacctgattagacatgaaagtcgcttgggaaaggactccgagaaaatacacaagtggaagtcagctttgtatgaagttgccaccttggccggatggtgtttcggagacggaagctgcaggtatggcgttttttcttcttcttaatttagctagtaccgcttcttaattttaaaaaaagaaaatgaaaataataattttttgtaggcattcaatactgccttacactttgagagaaaaaagaaacacagaacaacgtgacattaataagagagataatgaaaaatataggtgtaaatatgtttttaatagtttagtgttttttttttaatttttgtaatttttgttatttttagtctttataaattatatatatatatattttacttttagttttaaaattactttaaatagtactctagatagtaaaaaaaaaagtcctataagaaccaaaataaaaataaacattgtttgtaaggattaaaacaaaaaataattttataaaaacaaaaaaataaatattaaattataagaattaaaaagatatttaagttaaaaataaaatgtttcgatccaatgaatttttagcctaggatggtgtttatgtatcattgttgaaattaaaatttcatatactaagttaagtaactcatgccgattattattgctgaagtcatgtaaacttgcattttaatcctcaaagaccaaaaccacttgtgatatttgcacgaagcttttttccttgatttataccttattgaatattctaacttctgagttgtcaaatgactcgttaacatgggcttgagccagtttatgtctagaattgcaaggctttggccaatattcttaaagtgacaatctaacgtaactagttaattctcctttcattcttaaaagaaaaacaaaatagaaaccaacaataattatactctttgataaggaatttgttttatgaattatcacactagaatttattattggtaagaaacaatctaagcttttagctaatttatcaagttaattttactttgttttgacttacgagttttaaggtttgaaatctttggggagattaattattcaaactcaattttattatattaaaaaaaattcttttaagcactctttattaaaattataaaatttatagatctcactttttacttaataattttcattcataatttttaattaattgtaagaaatgtgcaagtgtgtgagagagtttcttgcttgaacccgtcttaaagtaatcaataatagataaagaaaaacgtaaccagtgcatgaatgaattaaaaggtcatgtacttttttgtaggtaccaatatgaatatgaattcatcgaaaacattgtgcgagaagccatcgccattgtaccccgctatagcatttttctgagttttagtggaaacgatacccgctcctttacaggttttctgaacaatgcattgtgccggagtaggtaccaaaccttcatgaatgatggggaccaaatttcacaatctactaatggagttattgaagaatcaaggctttcgatcattgtattttctgaaaactatgcacgttcctcgtcctgtcttgatgtgcttttgaccatccttcagtgtatggagacgaaaaaccaactgatttgtcccatcttttacaaagtgttaccgtcggatttaaggcatcaaagaaatagctatggtgaagccatgactgagcatgaaaatatgttgggtaaggactctgagagggtgaagaaatggaggtcagctttgtttgatgtcgccaacttgaaaggattttacttgaaaaccgggtacaacacatattattcttttactttttgcttattttcatgattcatgtctattatactagtaatagttgatgataataatcacttaatatgtgcatcgttcttgaaattctatgaaccgtttaatttgaaatccgttcatttaaatttgactttgttaacaaggaataacgttgtgagagacattggggtacggagttaaggctttgtttagagtttgcaattctgtttttgttgttgtgtggtaattacttttgtgcggatttactttgataattttagaaagaaaatgaaaattgtgtatgaatgaactaaaaggccttgtatttttgtaggtacgaatatgaatttattgacaaaatcgtggaaatggccagtaaaatttaattagagctcgctgtttcattactgtggtagtgctataaattggcctactttttgtttcttacagtctattagcctagcagccgttaggcctcttttttaaatgtaataagttgaattcctgaactcgtgaagcttgccccttattgaaccgtagtgtttttggttgcttaataccattaagcaatgagttgttttggatttatatgcatttaccgaattttatttggatgatagtaagcgttttttccatgttcacaaatatgccatgaaaaaagcagtaaaatttcaataaaccaacatcatgataaaacaaaagtatgcatcgtatgaaaaaaagtgggtgatgaaatgataagtctaattttggtcgaatttggtcgttgttatttttgcatgaacatctcttttgtacaacctaacaacttatttgctatttttaatatttttgtactgcttttgatttgcttgctcttcacaatattatagtgttgcattagttgttcaattttggttgtacaaataatacaacttttaagcagttatcgtgaatgttagaaaaatcatgtgacttatctctgttattgggtgattgcatttgtttcgtgacttgtctttaatcggttacttattttcaataataaataacaatatagcattattttgtgtcactttcttacttttgattattgaaaagccgtgctcctttgcctgtctcttgagccatgtgattcgtcgtgaattgtgaggacgagatcatatttgagaaagaaaatgtgagctagacgtttctatagctttattacgtagcccttgcaattcaattcagcagggaacatatcaaaatgatttgtattgaaaaaattgttctacctacaaaaatctactttattatttgtactgaacgagaaagtgccacaatacttaattagataagtagacattggagctaatctcaaaattcttgcctgctttttctatcatatatctccatatcactaatgaattcattcggaccgctaattagctaagagacacttgtgtgattgagagaaacactaatcttgtgaggactgaagtttggtgattatttcttgtgatctgtcgacaaaaatatcaaatggggtttcttttacaaattatttacctaaatgaatctgttttgaaaatatttactccattgggtctatttttttattacaaagcgtctccctgaagggcgcgttccccgtgaaagtgacacgtggcaggacttgggacgtgccctgcgtacaggcgcgatagttagtgttgttacagcaggcgcatcgggtcgtgttggggaccaaggtacgacaggtcgcgctgggtgacccagacacgacccaattgggtcgcactttatttaatattttttatattttgtatattgtttttatttaatatatttttatattattttatttaatttttttatattttatataatagtttctatattaaataaattcttagcattatgtatgattttaaagtcataaataattttttatattgtttttatttactatattttttatattttatttaatatttatatattaaataaatccttcatattagaaaaaataaagaaaatattaaataaaatataaaatataaaaaagtaaaaaatattaaataaaataatataaaaaatattataaaaacaatataaaaaatataaaaatatttaataaaataataaaaaaaatattattttaaataaaattatttatgactttaaactctaaagttgaattttaaaaaaatataatttttttacgattttagtaaaaaaaaaatacaagccgcacaatacaagtcgccttctcaaacccttcctcacgacattctcggaccttatgacaccgtcaccaaaacaatgatccacgcgatattaggcgcgtgcaaatcactctaatccgaaactagtagacatgggaagcacgagctatacgcgagcgtttcaattgccgccacgaaagcagagaaggccagaaacggaaccacggtaaaatggtaagggtattttcgtaaacagaagaaaagagttgtagctataaataaaccctctaacccacggcgcactatttctcttcactccttcgttcactcttcttctcttgcggctagggttttagcgcagcttcttctaggttcgttctcttccgccgctctatggattttaaaccttcgaatcatgtttattccattgaattatgttgcttgcagtttatattttctgaatctgtagttgttgtcttcaatttatcctatgctttatagatcaatcttttgtgtgtgtagtacgtaatttttgttctttttgcttttcgttcaagttgttgggaataatcggggtatcatgttttgatattgtttgttttcttttttgactgcttaataatttttaagttggttttggttttggggttttatgtgcttgttatattcaaatctttgtgatccagatcttacaaaagttttgggtttaaggatgtttttggctgatgatgaatagatctataaactgttccttttaatcgattcaagcttaggattttactaggcttttgcgaataaatacgtgacagtaagctaattatgtcctttttttgtctcaatcatatctgtctgggtgtgccataatttgtgatatgtctatctggtagaatcttgtgttttatgctttacgatttggtatacctgtttttgaacttgttgtatgatgggtatttagatcaccctatcttttttatgcttctggaagttttatgtaaatgtcgaatatcttaatgttgttgaacttataatgttgtgttgatgtatgtatgatggttttgacaacttttttcactggttctgaaagttttatgtaaattgcaaatatgttaatgttgttgaacttattttttttccttcgatgttgttttgatgtatgtatgatggttttcaccgtagtttctatggctaatatcttaatgttgttgagcttatttttttccttatatgttgtgttgatgtattgtatgatggttttgacaacttttttagtttctttgcagatttaaggaagaaaaaaaaaatggctcttgttgctagaccagtgctttctgctagagttgctgcttctagaccaagagttgctgcaagaaaggctgttagagtgtctgctatgtctcatggtgcttcatctagaccagctactgctagaaagtcctctggactttctggaactgttaggattccaggcgataagtctatttcccaccgttctttcatgttcggaggacttgcttctggtgagactagaattactggacttcttgagggcgaggatgttattaacactggaaaggctatgcaggctatgggagctagaattagaaaagagggcgatacctggattattgatggtgttggaaacggtggacttcttgctccagaagctccacttgatttcggaaacgctgctactggatgcagacttactatgggacttgttggagtgtacgatttcgattccaccttcattggagatgcttctcttactaagaggccaatgggaagagtgcttaacccacttagagagatgggagttcaggttaagtctgaggatggtgataggcttccagttactcttagaggaccaaagactccaaccccaattacttacagagtgccaatggcttctgctcaagttaagtctgctgttcttcttgctggacttaacactccaggtattaccactgtgatcgagccaattatgaccagagatcataccgagaagatgcttcaaggattcggagctaaccttaccgttgaaactgatgctgatggtgttaggaccattagacttgagggaagaggaaagcttaccggacaagttattgatgttccaggtgatccatcttctaccgctttccctcttgttgctgctcttttggttccaggatctgatgtgaccattcttaacgtgctcatgaacccatctaggaccggacttattcttacccttcaagaaatgggcgctgatattgaggttatcaacccaagacttgctggtggtgaagatgttgctgatcttagggttaggtcctctactcttaagggtgttactgttccagaagatagggctccatccatgattgatgagtacccaattcttgctgtggctgctgctttcgctgaaggtgctactgttatgaacggacttgaggaacttagggtgaaagagtctgataggctttctgctgttgctaacggacttaagcttaacggtgtggattgtgatgagggtgagacttctcttgttgttagaggtagaccagatggaaagggacttggaaacgcttctggtgcagcagttgcaactcatcttgatcataggatcgctatgtccttccttgttatgggtcttgtttctgagaacccagttaccgttgatgatgctactatgattgctaccagcttcccagagttcatggatcttatggctggacttggagctaagattgagctttctgataccaaggctgcctgactaattagctaagagcttgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta

SEQ ID NO: 33 - DNA, 14158 bp, Artificial
  Vector
attcctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaacccgggggcgcgccgggacccttaggaaatatggtggctgtactcattttgatgttgatgaatggtttaactgaattccgtttattatcatttttttttttttttgtattatataaaatgaaatgtatagagttgtacaaaaaaaatgaaaccagagtttagagtttatcaacatagagccaaaagttcacgcgataggggtcaaaatcgaaatatagtgtgaacaaataataaaacataatgaaataaagcaaaatcataaaagaaaaagataaaataatgtttgtacaaaaaaaaaagataaaataatgattgtagtatctaccaaaaaaataataataataatgatggtagtctctcatctgtttgactgaattaaatttatttgacaactttaaatgagttttttctttgataaaaactttaaattatagtataaataatatattataatacctatacacatatatttaaaaagttaagaaaatgggtagaccatgtcatggtttaaaaataaaaaataatttgacaaaaatcataaaaaattaaataaccaagttaataataacaagaatatttaatcatgattttattatattgttgttgacctattgactaatacatactaaaaataaacacacaagaaggagtatggagacctaaaatcgaactcaggattcaacataaaattgttatagtcaaaccattgggttataacaatggggacaataatgaaaatataaaaatgaaccaaaattataaaacaaaaaagataaaataatgatgacaatttctcatttgtttgattggtttggttttatttgacaattttaaatgagttaaataatatttctaatacatacatattaaaaatttaagaaaattgggtagaccatagatccttccgctttatatcaatataattttctcgatgtaaatgggcattttccctcttttgcacaaaaaaaaaaatctcgatgttacattgatatttatgtgcgcctaagactttacattgatatatttatttggtgcgccttcattttttctatattatatcataaattttaaaaacaaagttacaaacacaaagcgcgccttcatttttctatattatatcataaattagaattacgttctcgaagagtcaaaccaacctactgattacgttctcggagagacaaaccaacctagtgatttactactagctaattttggttattcctcgaaagtttactttataatcgtgaaatgttattctgattttcttttgaggccaaaatcgtatccgactcacgagagattgctagtttttcttttgcagccaaattcctttacattttaacaaaagaattttttttttttggtcaagtagccacctagtggctagagcacacacaatttaattgtggagaagtggagtgtctggggttcgaaccccggcccctgcatataatatgcaatatccctaccaactgagctaagctcacgagaattaaaaaaaaagaatattaatctaactaaatatacagttaagcgcaatagaaaaacagacgaacaaaagaaagaaacgttgatatataattattggagaatgctaaccattgttagtattgaaaaatggtgaaaaatgataaatttaactttttaaaagtcaaaatattattgaaatcaatataaacatactacttttgacttctttaaccattaccagagggcaatggttaacgagacccataattattctaaggagctactttgcagataggggatgtccttttttttttttgttgaaagaaattaggggatgtccttatctctttatccctgccaattttcctatttataaataaatatcgagtttatcgctctccacctcaaacgctttctttcttgttcttggtttagggttttcttcacccattagggttagggttcaattttccccttttcaatccccaaatcaaaattcaatcaaaacctcaaatttctcaccttttctcactcaatcatcaatcaaggatccaaaaatgtcgaatgaactcaaaaactacgatgtttttctcagttttcatggcgaagattcccgttacaccttcactggtactctctataatgctttgcgcagcaagagaatcaagacctttttcacagaacatgaatatgatcgtaaactacacactcatgacagccaaattccacactctactcttgaagcaatcaaggaatcaaggatttcgatggttgttttctcggaaaactatgcatcctcctcaagatgtcttgatgaacttgtggccatccttgagtgtaacaggacgataaaccaactggtgtggcccatcttttacggagtgtatccgtggcaagtaaggcaccagggcggtaactatggagcatctatgtctaaattagaagaaatatttagagattccaatgagagggtgaagcaatggagagcagctttatttgaagtcaccaacttgaatggatggtgttaccaaactgggtatgcttaattttagttgattaagttccattattaatctctacaactgctagcatagcatggcaccacttctttattacttattgtatctgtaatctgctgaacagtatgtctgatcttctaattatcgttttagaaagtcactttgttttgtttaaccgagagaaatacatgtgtgctgtaaattaaaggttctgtttccagtttcagtgtagcagtagcaatctgttctgtgcatacatatagattagtcaagcttaagtcaacttataattctgattaatagaaacaatatggttgtccatgctcgaatacccctggtgaattaaaaagacttgtgcttttataggaggtaccagtatgaatatgaattcatcgaaaggatcgtggaatcagccgtgcaagccttgcccggatatgatgtttttctgagttttaccggagaggatacccgctatactttcacaggttttctctataatgcctttcgccgagagggattcaaaatcttcatggacgatgaggaattggagagtgggaaccaaatatcacagaagcttatgggagcaattgaaagttcaaggatttcaattgttgtgctttctgaaaactatgcatattccacgtggtgtcttgatgaacttgccaagatcattgagtgtatgaagaccaacaatcaaatggtttggccaatattttacaatgtgcaaaagtcggatgtatgcaatcaaacaaaaagttatggtgaagccatgactgaacatgaaaaaagatttggaaaggactctgagaaggtgcagaaatggagttctgctttgtctgaaatcaacaatttggaaggagaccatgtcaaagaaaatgagtacgtaatgcttttaattagttacttaatatatgcttccctcttaagtgatattgaccatctatgaaatgctaaacatggcatagttcttgtccgagacatggggtattgtgtgttgttttgtttggagcagtttttgtattttgtacggcaatctgttagtgagaagattaattagtcgagcttaatattgttgttttattgacataaagtctgattaggagaaataaagtgaacacagcggatgaatgtcttaaaagaccttgcacttttgtaggtaccaacatgaatttatcgaaaggattgtacaaaaggtcattaaacttgaaggtagcaagcatatagcaaatcctttccttttatccaatgacagctacgaggaagaatgattaattgagctctctttatcatcatcaacatcatcgtgtgactttaatcgacccttcattcatggcttttactatatgttctattttgtaatctttttcttttcaagttgtctttttttagagggtttttgaataatttgtcaaatgggtatgcttaggtacttttatgtctttttaatatcaaaatgatgcattttggatatgaatgttgttatgatgctgtctatgaagtggtgctgaaaagggttgttgatgggaattggattcagttgtgctgttattgatttggcccttcttaaaaccttgaatgtaatatattgttccctggatggaggttaatatgatggtgctactagttactactatatcttgttctgtgctctgatttgttgttctgtgatcaaataacttgtttaatccttggatcataagctggcttgagttgttggtttagtttattttttggtatgtttggttttgcggcaatttttccgcgatagctcaaaacctatgctagtttttcacgtctatatagacacgcaacaacacaactgaatgtgagttcaggctcaaacaccaaacagaacatatgctccgtgattgtcagtattaaatctggggcaatgaggttttgtaaaatttctatccggtggcggttaagttcagtattttagtttttgaaagtatatattgaaatctggattgtccgaatgtaacagtcaccagtgtagctcacagtgtaaccttagatgattgtgacccacaaggccacaatccaaatttgttggttttatgatggatgtgtaataatgcaacttttgccctgcatttggtttttatactaaattagtttagaaggataaccaaaagctactaggcagtgatacaatctagacatacggatgttattgatgatatattttacattctggattttatataatctgaatctctattctggagaaatttagccataaagcattttgagtgatcctctgttccttttccttagacggaccgctaattagctaagagacacttgtgtgattgagagaaacactaatcttgtgaggactgaagtttggtgattatttcttgtgatctgtcgacaaaaatatcaaatggggtttcttttacaaattatttacctaaatgaatctgttttgaaaatatttactccattgggtctatttttttattacaaagcgtctccctgaagggcgcgttccccgtgaaagtgacacgtggcaggacttgggacgtgccctgcgtacaggcgcgatagttagtgttgttacagcaggcgcatcgggtcgtgttggggaccaaggtacgacaggtcgcgctgggtgacccagacacgacccaattgggtcgcactttatttaatattttttatattttgtatattgtttttatttaatatatttttatattattttatttaatttttttatattttatataatagtttctatattaaataaattcttagcattatgtatgattttaaagtcataaataattttttatattgtttttatttactatattttttatattttatttaatatttatatattaaataaatccttcatattagaaaaaataaagaaaatattaaataaaatataaaatataaaaaagtaaaaaatattaaataaaataatataaaaaatattataaaaacaatataaaaaatataaaaatatttaataaaataataaaaaaaatattattttaaataaaattatttatgactttaaactctaaagttgaattttaaaaaaatataatttttttacgattttagtaaaaaaaaaatacaagccgcacaatacaagtcgccttctcaaacccttcctcacgacattctcggaccttatgacaccgtcaccaaaacaatgatccacgcgatattaggcgcgtgcaaatcactctaatccgaaactagtagacatgggaagcacgagctatacgcgagcgtttcaattgccgccacgaaagcagagaaggccagaaacggaaccacggtaaaatggtaagggtattttcgtaaacagaagaaaagagttgtagctataaataaaccctctaacccacggcgcactatttctcttcactccttcgttcactcttcttctcttgcggctagggttttagcgcagcttcttctaggttcgttctcttccgccgctctatggattttaaaccttcgaatcatgtttattccattgaattatgttgcttgcagtttatattttctgaatctgtagttgttgtcttcaatttatcctatgctttatagatcaatcttttgtgtgtgtagtacgtaatttttgttctttttgcttttcgttcaagttgttgggaataatcggggtatcatgttttgatattgtttgttttcttttttgactgcttaataatttttaagttggttttggttttggggttttatgtgcttgttatattcaaatctttgtgatccagatcttacaaaagttttgggtttaaggatgtttttggctgatgatgaatagatctataaactgttccttttaatcgattcaagcttaggattttactaggcttttgcgaataaatacgtgacagtaagctaattatgtcctttttttgtctcaatcatatctgtctgggtgtgccataatttgtgatatgtctatctggtagaatcttgtgttttatgctttacgatttggtatacctgtttttgaacttgttgtatgatgggtatttagatcaccctatcttttttatgcttctggaagttttatgtaaatgtcgaatatcttaatgttgttgaacttataatgttgtgttgatgtatgtatgatggttttgacaacttttttcactggttctgaaagttttatgtaaattgcaaatatgttaatgttgttgaacttattttttttccttcgatgttgttttgatgtatgtatgatggttttcaccgtagtttctatggctaatatcttaatgttgttgagcttatttttttccttatatgttgtgttgatgtattgtatgatggttttgacaacttttttagtttctttgcagatttaaggaagaaaaaaaaaatggctcttgttgctagaccagtgctttctgctagagttgctgcttctagaccaagagttgctgcaagaaaggctgttagagtgtctgctatgtctcatggtgcttcatctagaccagctactgctagaaagtcctctggactttctggaactgttaggattccaggcgataagtctatttcccaccgttctttcatgttcggaggacttgcttctggtgagactagaattactggacttcttgagggcgaggatgttattaacactggaaaggctatgcaggctatgggagctagaattagaaaagagggcgatacctggattattgatggtgttggaaacggtggacttcttgctccagaagctccacttgatttcggaaacgctgctactggatgcagacttactatgggacttgttggagtgtacgatttcgattccaccttcattggagatgcttctcttactaagaggccaatgggaagagtgcttaacccacttagagagatgggagttcaggttaagtctgaggatggtgataggcttccagttactcttagaggaccaaagactccaaccccaattacttacagagtgccaatggcttctgctcaagttaagtctgctgttcttcttgctggacttaacactccaggtattaccactgtgatcgagccaattatgaccagagatcataccgagaagatgcttcaaggattcggagctaaccttaccgttgaaactgatgctgatggtgttaggaccattagacttgagggaagaggaaagcttaccggacaagttattgatgttccaggtgatccatcttctaccgctttccctcttgttgctgctcttttggttccaggatctgatgtgaccattcttaacgtgctcatgaacccatctaggaccggacttattcttacccttcaagaaatgggcgctgatattgaggttatcaacccaagacttgctggtggtgaagatgttgctgatcttagggttaggtcctctactcttaagggtgttactgttccagaagatagggctccatccatgattgatgagtacccaattcttgctgtggctgctgctttcgctgaaggtgctactgttatgaacggacttgaggaacttagggtgaaagagtctgataggctttctgctgttgctaacggacttaagcttaacggtgtggattgtgatgagggtgagacttctcttgttgttagaggtagaccagatggaaagggacttggaaacgcttctggtgcagcagttgcaactcatcttgatcataggatcgctatgtccttccttgttatgggtcttgtttctgagaacccagttaccgttgatgatgctactatgattgctaccagcttcccagagttcatggatcttatggctggacttggagctaagattgagctttctgataccaaggctgcctgactaattagctaagagcttgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcaggcccgggggcgcgccctaattagctaacggccaggatcgccgcgtgagcctttagcaactagctagattaattaacgcaatctgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccagggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctggctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaatta
